United States Patent 11,446,398 (REGULATED BIOCIRCUIT SYSTEMS) - sequence listing, part 48

SEQ ID NO: 138542 - DNA, 4294 bp, Homo sapiens
  Payload ID: 7148
  Gene Symbol: GPALPP1
  Gene Name: GPALPP motifs containing 1
  Uniprot ID: Q8IXQ4
  ENST ID: ENST00000497558
  CDS Start-End: 36-1058
agactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttactgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcagcttactgcaacctccgcctcctgggttcaagcgattctcctgcctcagtgtcccaagtagctgggactacaggcgtgcaccaccatgctcagctaatttttgtattttttagtagagatggggtttcactatatattgttccaggctggtctcgaactccagacctcaggtgatctacctgcctcggcctcccaaaatgctgggattacaggcatcagccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctataatcccagcactttgggaggccgaggtgggtggatcacctgaggtcaggagttcaagaccagcctgaccaacatggtgaaatcctgtctctattaaaaatataaaaattagtcgggcctggtggcgggtgcctgtaatcccagctactcaggaggctgaagcaggataattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactgtgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctat

SEQ ID NO: 138543 - DNA, 899 bp, Homo sapiens
  Payload ID: 7148
  Gene Symbol: GPALPP1
  Gene Name: GPALPP motifs containing 1
  ENST ID: ENST00000611650
  CDS Start-End: 127-429
aggctttacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctggtaagcggcggcgtctccgctgcccaccaggcccatctacccactccctggccgggccctgctcgctgaagaaagtcggaggcctaggagggcggaggagtggggagtgggcgcggcctgacccgagagaacttttctcttcccaaacagtagcaggggggaggaggctgggggaccctcctagaaacgagctttggcgtggtttggcttcgtgatgataatacattctcatttagccttaatatgagctgcacgctgccctaactgactgatacccactcagtcatttaagccgtataagaaaaaaactattttcccatgttgcaaatgggtacgcccaagcccatgccagtgtctagatcatactgctagcaagtgatggagcgcgacttagaaggaagcggttctcttaacctctgtgccatattgccttctgattacaagaaccttgcagatcctgttctctccagcccccgacctgccttcctagcctctcattctgttattgcatctgacaaacacagcccaatactcaatccagtctgagttgctgcgcaattccttaacgctctaggcttctgggcttcctctggttgcattcctaaacataactgacaaacttctccccatccttcaaggcccaacttaaatgtcacaccaataaaacctttccagattccccgaa

SEQ ID NO: 138544 - DNA, 2496 bp, Homo sapiens
  Payload ID: 7149
  Gene Symbol: GPN1
  Gene Name: GPN-loop GTPase 1
  Uniprot ID: Q9HCN4
  ENST ID: ENST00000264718
  CDS Start-End: 22-1188
attgcggaagtttctctacccatgcggtgtctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaacttagtggttctcacattgtggaccaggagcatcagcatcatctggggaattgttcaacttacctcttataacctatgaactcagaaaccctgggggtgggctgagcagtctgttttagaaagccctccatgtgattctgatgcatagtagcctatgacataattccagaccaggtgaatctcaagatactaatcctcacatcatttgccttctcatatttccctcgtcttgaccatctggtgcctgttatgcagtttaacattctgcagcaataaaagtgttttattataaa

SEQ ID NO: 138545 - DNA, 1395 bp, Homo sapiens
  Payload ID: 7149
  Gene Symbol: GPN1
  Gene Name: GPN-loop GTPase 1
  Uniprot ID: Q9HCN4
  ENST ID: ENST00000407583
  CDS Start-End: 51-1139
gagcagccggtcctccagtggctccgctccccgttctctgtgggctcaaaatgacagggcatactcggtccagcttaccacgttgtacaggaattgtcttgctgataaaattgcgtttctcggagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgata

SEQ ID NO: 138546 - DNA, 577 bp, Homo sapiens
  Payload ID: 7149
  Gene Symbol: GPN1
  Gene Name: GPN-loop GTPase 1
  ENST ID: ENST00000436280
  CDS Start-End: 36-257
gtctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagaga

SEQ ID NO: 138547 - DNA, 1725 bp, Homo sapiens
  Payload ID: 7149
  Gene Symbol: GPN1
  Gene Name: GPN-loop GTPase 1
  Uniprot ID: Q9HCN4
  ENST ID: ENST00000424214
  CDS Start-End: 194-1081
gaataagcccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaatttt

SEQ ID NO: 138548 - DNA, 1618 bp, Homo sapiens
  Payload ID: 7149
  Gene Symbol: GPN1
  Gene Name: GPN-loop GTPase 1
  Uniprot ID: Q9HCN4
  ENST ID: ENST00000458167
  CDS Start-End: 135-974
gaataagcccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaatttt

SEQ ID NO: 138549 - DNA, 1646 bp, Homo sapiens
  Payload ID: 7149
  Gene Symbol: GPN1
  Gene Name: GPN-loop GTPase 1
  Uniprot ID: Q9HCN4
  ENST ID: ENST00000515877
  CDS Start-End: 596-1483
actgtttgcagctacaaagggtcacagaaacagactgggtggtcaggagtagaaataattttctaggctctttcatcatctttcctgagtttctgagggaccttcagtgactggaggggaggaagctcccctccagtacctacttgcacctggaatccaagcattcatcctgaaggtcacggcaactgtgtagttcactgagggtgactgccaaggaatgagcgctagcatcaggaacctgcgtctgcaactcgcgggaacaatgtgcaagtgtggaaagctcccgtagtttattcgttcggtgctcaaagggtctcggtgctgcccagcaaccctggagactgcaccctgctccagtcccggctggtccagccctgaactgtttaaccgcctcggctaccgaataagcccgagcagccggtcctccagtggctccgctccccgttctctgtgggctcaaaatgacaggcatgctcctcgacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtca

SEQ ID NO: 138550 - DNA, 984 bp, Homo sapiens
  Payload ID: 7149
  Gene Symbol: GPN1
  Gene Name: GPN-loop GTPase 1
  Uniprot ID: Q9HCN4
  ENST ID: ENST00000503738
  CDS Start-End: 136-975
gaataagcccgagcagccggtcctccagtggctccgctccccgttctctgtgggctcaaaatgacaggcatgctcctcgacacctgcatgcccaaggcactccaccgtatgtgatcaacctggatccagcagtacatgaagttccctttcctgccaatattggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagacttta

SEQ ID NO: 138551 - DNA, 1778 bp, Homo sapiens
  Payload ID: 7149
  Gene Symbol: GPN1
  Gene Name: GPN-loop GTPase 1
  Uniprot ID: Q9HCN4
  ENST ID: ENST00000610189
  CDS Start-End: 8-1132
gaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaa

SEQ ID NO: 138552 - DNA, 1832 bp, Homo sapiens
  Payload ID: 7149
  Gene Symbol: GPN1
  Gene Name: GPN-loop GTPase 1
  Uniprot ID: Q9HCN4
  ENST ID: ENST00000616939
  CDS Start-End: 22-1188
attgcggaagtttctctacccatgcggtgtctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaatttt

SEQ ID NO: 138553 - DNA, 715 bp, Homo sapiens
  Payload ID: 7150
  Gene Symbol: GPN2
  Gene Name: GPN-loop GTPase 2
  ENST ID: ENST00000374133
  CDS Start-End: 19-414
gagaaatggagtttcaccatgttggctggtcttgaactcctgacctcagccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcagagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctactttt

SEQ ID NO: 138554 - DNA, 4678 bp, Homo sapiens
  Payload ID: 7150
  Gene Symbol: GPN2
  Gene Name: GPN-loop GTPase 2
  Uniprot ID: Q9H9Y4
  ENST ID: ENST00000374135
  CDS Start-End: 202-1134
ccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgccccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcagagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctactttttgtgacttccaaacttttcttcagtcttccgggcccaggggtttggggaagaatgagggagtgtcacctagccttggaataatcagtatttccccaaagcatataattcacattcagtcacataggatttacattcagtctccagtcatgtgtttttattaatcttcagtttttggttctgaggtttgttttttaaaagatggggtcttgctatatggcccaggctggactcaaactcctgggctcatgtgatcttcccgcctcagacgcctgagtaactgggactacaggtgtgagccaccatgtcccacaattttcagttttaacagagcctcaagcttcagctttcacaggcaacacttcctaactagaactttgttaatgttttatattcactgtatttgttttatggttttattctattgttgacaagtgttaactagttttccatttacagtagtggttaaaagtttacttcaaggctgggtgcggtggctcacgcctgtaatcccagcactttgggaggccgaggcaggcggatcccaaggtcaagagatcgagaccatcctggccaacatggtgaaaccccatctctaccaaaaaatttttttaattagctgggcataggtggcgcgtacctgtagttccagctacttgggaggctgaggcaggagaatcatttgaacccaggagtcagaggttacagtgagctgagattgcaccactgcactccagcctggtgacagagcgagactttgtctcaaaaaaaaggtgtacttcaaaaatgaaatacaaggctgggcgtgttcactcatgcctgtaagcccagcactttgggaggctgaggcgggcggatcacctgaggtcaggagttcgagaccagcctggccaacatggtgaaacccctctctactaaaaacataaaaattagctgggcatggtgttgcacgcctataatcccagctattggggaggctgaggcagaagaattgcttgaacccaggaggcggaggttgcagtgagccaagattgtgcctacattccaacctgggcgacagagcaagactctgtctcaaaaaaaaatagtaagttgtgtaaagaaaaatattaattatataatatggcagttcctatgagagtgtggcaaaaatcaagagggcttggaagttttttctttgctcttgcaactggctggatgcagttcatatatttttcaaccagtaggtggcaccccaacctaattttttgcagttgtaacctggtggcagaaggggcaggactgatggcttgggcaagactgttatgccaagttttatttgcatgtatttggactttctttttttggagacaaagtctctctctgtcgcccaggctggagtccagtggcacaatctcggctcactgcaacctccgcctcccaggttcaagcaattctctgcctcagcctcccgagtagctgggattacaggcgcctaccacatgcccggctaatttttgtatttttagtaaagacggggtttcaccatgttgttcaggctggtcttgaactactgacctcatgatttacccgccttggcctcccaaagtgctgggattacaggcgtgagccactgcacccggccacatttggacttattaacacatatgaagtgcttggtattttagagtgcttccacacacacaatcctcattagagatagacaggatggggagaattaataagccattgcccgtgttacagtgaggaagcagaaagatgagaagtttgaactttggtcagcctggctttctcataacccattttgctgactaaattgcgagtatccctcctttggtatatttattggtgagaagtcacagcccttgtcccacaggttttgcagccaatcaggagaaagaaattaggcacctgtaaagtattactgaatcatagatagttcaccagtggtttgggcagttggcaaattaatttagggacatctgttctgaaacagcattgaaataggactgactgctttgctttctggttgtggcagccagagccaaaggcagatgaatgaggggctatgaggaggctactgtggctggaacagtatgaaagcaacctcagctcccacgcctggctgtaaaggggataataactgggtgctgcttcccagcctctttcatctgagaagttcaaagcacctcacccctattaacaccccacagagtaggtaggaagtaccaatagagcaagccaggaaaactgaggccaggaggcacagcctggggctagctgtgaatcacctgtggggcctagagcccaggaatcctgacgcccaggctactggacaaatcctttatcagggcattagggtgggtgctatgcttttgaaagcagtaccaacggctgtggtcgtgggttttgatgcttgccactcacagaggccccagctctcaccataacaaaccaaatgggggctggaaggcatcctttacaactttatggtctcgtatgcaagcaccctcagcattctctgcacccatggagtggagatgggtgggagtaatccaaggcctttattttcaggccatggtttgacagcaagggtattttcttccccaataaacgtagcttctgtctaccttccactggcagcaaaatgattttctgttctctgcatatactgaggggatctgcacagtgcagaaaggaagatgtccgagatccaagtgaggcctgttcagtgtgaaatgtctagggtagaagaaagaccatcctccattatggctggcatgtggcagtcatccttaagattatttttaaatttcctaataaatataggaaagtaaaaaacttagaaaatgaaagagaaggccgagcacggtggctcacgcctgtaatcccagcactttgggaggccaaggcgggctgatcacctgaggtcaggagtgtaagacaagcctgaccaacatggtgaaaacctgtctctgctaaaaatacaaaaaaatgagcagggcatggtggcatgcgcctgtaattccagctacttaggagactgaggcaggagaatcgcttgaacctgggaggcggaagtttcagtgagcggagatcgcgccattgcactccagcctgggtaacaagatggaaagtacatctcaaaaaaaaaaaaaacgaaaatgagtcacccagaatcccataacggaaactttctatggggtcatctgtttaagagaaaaataaattctatattcaaatgt

SEQ ID NO: 138555 - DNA, 739 bp, Homo sapiens
  Payload ID: 7150
  Gene Symbol: GPN2
  Gene Name: GPN-loop GTPase 2
  ENST ID: ENST00000431781
  CDS Start-End: 165-503
atctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgccccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtt

SEQ ID NO: 138556 - DNA, 1468 bp, Homo sapiens
  Payload ID: 7151
  Gene Symbol: GPN3
  Gene Name: GPN-loop GTPase 3
  Uniprot ID: Q9UHW5
  ENST ID: ENST00000228827
  CDS Start-End: 64-918
ccggagctcagtgggcgtcgcgcgaaggctaagggagtgtggcgggcggctccgggagccaacatgcctcggtatgcgcagctggtcatgggccccgcgggcagcgggaagagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagatatgtatgtgtatatataaaagaaacaaaggtttttaatgattcttggacctagataacaagtaca

SEQ ID NO: 138557 - DNA, 1604 bp, Homo sapiens
  Payload ID: 7151
  Gene Symbol: GPN3
  Gene Name: GPN-loop GTPase 3
  Uniprot ID: Q9UHW5
  ENST ID: ENST00000543199
  CDS Start-End: 86-1057
ggaggggcaggagcgctgcggtcgctgagcgtttgcacgtttgcacctctctgtggaagcagtgcgtcacaggagggaaatatacatgctccccaaaacaagaggtgccttccacttcagtattccagatcctcagcacatttgcaaatcgcgagggtcaccatacaggtcaaacgtctgcacgcaaaccacggaccgaagcacgtggcgcaaggatgcggagctttatctgttgtccgttattactcagagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagatatgtatgtgtatatataaaagaaacaaaggtttttaatgattcttggacctagataacaagt

SEQ ID NO: 138558 - DNA, 1491 bp, Homo sapiens
  Payload ID: 7151
  Gene Symbol: GPN3
  Gene Name: GPN-loop GTPase 3
  Uniprot ID: Q9UHW5
  ENST ID: ENST00000537466
  CDS Start-End: 62-946
ggagctcagtgggcgtcgcgcgaaggctaagggagtgtggcgggcggctccgggagccaacatgcctcggtatgcgcagctggtcatgggccccgcgggcagcgggaaggtgaggatctgcggggacaaggagagaaaaagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagatatgtatgtgtatatataaaagaaacaaaggtttttaatgattcttggacctagataacaa

SEQ ID NO: 138559 - DNA, 564 bp, Homo sapiens
  Payload ID: 7151
  Gene Symbol: GPN3
  Gene Name: GPN-loop GTPase 3
  ENST ID: ENST00000550974
  CDS Start-End: 88-564
ggagctcagtgggcgtcgcgcgaaggctaagggagtgtggcgggcggctccgggagccaacatgcctcgagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaa

SEQ ID NO: 138560 - DNA, 833 bp, Homo sapiens
  Payload ID: 7151
  Gene Symbol: GPN3
  Gene Name: GPN-loop GTPase 3
  ENST ID: ENST00000551079
  CDS Start-End: 1-363
tttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaata

SEQ ID NO: 138561 - DNA, 353 bp, Homo sapiens
  Payload ID: 7151
  Gene Symbol: GPN3
  Gene Name: GPN-loop GTPase 3
  ENST ID: ENST00000550228
  CDS Start-End: 1-353
acatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagattgatgactacagcatggttcgatttttaccttacgatcagtcagatgaagaaagcatg

SEQ ID NO: 138562 - DNA, 497 bp, Homo sapiens
  Payload ID: 7151
  Gene Symbol: GPN3
  Gene Name: GPN-loop GTPase 3
  ENST ID: ENST00000549963
  CDS Start-End: 421-497
aggggcaggagcgctgcggtcgctgagcgtttgcacgtttgcacctctctgtggaagcagtgcgtcacaggagggaaatatacatgctccccaaaacaagaggtgccttccacttcagtattccagatcctcagcacatttgcaaatcgcgagggtcaccatacaggtcaaacgtctgcacgcaaaccacggaccgaagcacgtggcgcaaggatgcggagctttatctgttgtccgttattactcaggacgcgtttctcacgggatttggcccgcgggctgccccgtagtaggaggtgtggtagaactggaggcgtagaaagaatgtggattgcgattggttcgcacttcactttcccggagctcagtgggcgtcgcgcgaaggctaagggagtgtggcgggcggctccgggagccaacatgcctcggtatgcgcagctggtcatgggccccgcgggcagcgggaagagcacctactgtgccaccatggtccagca

SEQ ID NO: 138563 - DNA, 2113 bp, Homo sapiens
  Payload ID: 7152
  Gene Symbol: GPR75-ASB3
  Gene Name: GPR75-ASB3 readthrough
  ENST ID: ENST00000406625
  CDS Start-End: 233-1903
aaaactgcgagcctgaaaaacctggctcaagcgcccctcgtgaggcgggcagcgggagtggccgggctctgggccccaggaggcaggcgacggaggcgcggagggtgcggggcgcaggcgggacgccaggcccgggtgtccggcggagggggcggtgccctcggcgtctccgtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaa

SEQ ID NO: 138564 - DNA, 6260 bp, Homo sapiens
  Payload ID: 7153
  Gene Symbol: GPRIN3
  Gene Name: GPRIN family member 3
  Uniprot ID: Q6ZVF9
  ENST ID: ENST00000333209
  CDS Start-End: 1085-3415
ggttacttaaatttcgtatcttgtaaactatgtttttatatttgttatccattttttcaatggattatttgatctcctcataaatgttaaagagctcctgctatattataggtatttttgcctgccctctagggttatacactttttatttcccccaaaatcttgtattttttatagcatcttttgtcatgccataaaattcaggttttgaattttatttagtcacctatgtttgttttctcttacagtgtttctaccatctcagaaaaagcctagctcacctgtctctagattacatttatgattcgtaggttttcttatatgattttatttatttattttatattttaacctttaatccactgcatccatctaggatttatttttggaattggtataatataaacatctacttttcttttcttccagatgcatgaacagtttgccaactccttctatgaaataactcagcctttcaccaccaaattgtaatacttcttttgtcatagattaagtccccatttatatttggatctatccctagatttcttatttcacatatctgtttatgcctacttcaatacttacttattgatttaattagagtggctttacaggattttctgacatctgctaagtcagattacaccaataacttttgaggtagttagcaaacttaggtagatacatgaaaaacctatttgctagacattagtgggatgcaagcagaaactaatatatcaaaataatattttcgtaattataatttttttcaaaatctttttctcaagtctatttttatttatttatttttcttctccctccccacaaggtctatttttatatcaacaggtatgggaagaaaagtttttaatgtgctcttataaaaacgacagtttggtttatttttcaatccttaagcgacgtactgtattaatgatgctgtttccttgattcacaggctggttcttcagaggaatcatccctgactgtgtcatcactctgagctctgactgcgctcccctcccccaccagtgggaccagtactcaagagagctctggagtgctcctgaagagaaattccatggggactgtacctgaccctctgagatcagctaaaacttccctgattgcagcttccggaaaagaagacgatctaggagagccacaggctgcctcacctcggcatcgaccagctctcctgtgtaagaatgccaatggcttttcaggtgcccctgcagaaccagacctcagccccagggcagctgccgaagccctgatgcaggtttgtgagcatgagaccacccaaccagatatgtcttctcctggtgtgttcaatgaagtgcagaaagcacctgccacattcaactctcccggcaatccccagctgccagggagcagccagcccgcagcatcagccccgagttctgcagcaggaagggatcttatacacacaccattgacaatgcccgccaatcagcacacctgccagtccatcccaggtgatcagcccaatgccatcacctcatccatgcctgaagattccctgatgagatcacagagaacctcaaatagagagcaacctgagaaaccaagttgtcctgtgggaggcgtcctcagtagcagcaaagatcaggtgtcctgtgagtttccttctccagaaacaatccagggaacagtgcagactccagtgacagcagccagggtggtcagtcactcatcctctcctgtaggtggacctgaaggggaaaggcagggagccatctgtgactctgaaatgaggtcctgtaaacctctaactagagaatctggatgttcagagaacaagcagccctctgtcactgcctcgggcccccaaggcacaacttctgtgacacctcaaccaacccccctcactagcgaaccttcggcatgtcccccaggtccagagaaggtgccgctgccagcacagcgtcagatgtcaaggttcaaagaagccagtacgatgaccaaccaagctgaaagtgaaatcaaggaagttcccagcagggcttggcaagatgcggaggtgcaggcagtggcgagtgtcgagagcagatccgtctccaccagccccagtatcctcactgcatttctgaaggaaagccgtgctcctgagcattttgaacaagagcagctgcgtgtcatttgccacagcagtgggagccacacactggagctctctgacagcacgctagccccccaggagtccagccagtgccctggcatcatgccacaggtgcacattcaggcagctgcagctgagtctacagctttccaacgggaaaataaacttgcgagcctaccaggtggggtccttaaaacctcatcaatcaatttggtctccagtaatgcccagcatacgtgtaaagaagatgggaggttagcaggaatgactccagtgagggaagagtcaactgctaaaaagctcgcaggtactaattctagctccctgaaagctaccgccattgaccagatttctatcagtgcatgcagtcaagctgaaacaagttatggattggggaaatttgaaaccaggccatctgagtttgcagagaaaacgacaaacggccacaaaacagacccagattgcaaactatctgactcttgtggctctatcagcaaagctgatcattctgggagcttggatcccactaataaaggagatgcaagggaaaagaagcctgcatctcctcaggtagtaaaagaaaaagagtctactggcactgatacctcggatgccaaaaccctactgctcaatcctaaatcccaagaaagtggaggcacagaatcagctgctaatcctacaccctccccaattaggaagaaccaggagagcaccttagaagaaaacagacagaccaagacagccaccagcctgagcctgccatctgatcccatgggtgactccagcccaggttctggcaagaagaccccatctcgctccgtcaaagccagcccacgcaggcccagccgcgtcagcgagttcctcaaggagcaaaagttaaatgtgacagcagctgctgctcaggtaggactcactccaggagataagaaaaagcagcttggcgcagactccaagctccagctgaaacagtccaagcgtgtcagggacgtcgtgtgggatgagcagggaatgacctgggaagtgtatggtgcatccttggacgcagagtccctgggaatcgcgatccagaaccatttgcaaagacaaatcagggaacatgagaaattaatcaaaactcaaaatagccagacccggagatccatttcctcagatacttcttcaaataagaagctcagaggaaggcagcacagtgttttccagtccatgctgcagaacttccgacgccccaactgctgcgtccgtcctgccccgtcttctgtgttagattgaaagggagtatttatgggagtttgtgtataaatttacggtattcacatgcgtccctctatgtcaaagcttgcttagttttttgctgcaagactaggaagaaaaagcaagtattcactataggaaattgctattaaaaattgttagatcctttgacctggagctctataaacaaaaatgtcatttcaatttgaaagaaggaacaagaaaagagaaacaagcttcactgaaggtttgcaaccttaacaaattgaaaataatactcactgggtttttaaaaatatgatgttgttcatagaaatagcattattgtatcattatacatgtattattttgtataactgcctcaatttatcacacagtagtagttccattaaaatccctgcttcatattgaaagtagcaaaaacactattggcgaaaacattgttataatttctagtcttattgcagtaagaatgctgtaaccacacaaattataaataggtgataagaaccataatgaaaaaaatgagaacatatttgattcattcctaggccagataacattaaataaaaacagttaaatgtgtaaaatatgaaatatgaattaatgtttataaacatctgcagacaactctttttataaaccttcttattgctgttaataaatataagaaagttatattaggaacattagctaagcttttgactatgaaaactgcctacattaaacatggatttatatagacccattttcctgcactgaaggcaaggcgcatctctgtgattctgaccagacatattcatattttcttaccctagaggaagtacatgggactgaattcttgaaaagagccatcaaattagggataatactaaattgatactgtgcaggtgttctccagtgatattctactgagaatgctaaggttctggtcaggaactataaatagcagattaccaaacactgctttttctgtgatgataaaagcctcataagtaacaaaaacaatgtttaatttagactcctgtaaacaggatgcaattagtgattttttttaattgggttcagtaacttccagtaacaaatgtagtcaacaccaaattagaatgtgagcttccttacaatttttgtacatagactactatcatctaattgcttaaatatatatgctggagtaaaaaggtaacttctgcaaacttattgattttaagagaaatacccataatatccttcaaacccaatgaaagaagaggcctttacgaaaacatggcttgtgatttgggtggattatacttcctgggaccttggccctcccgtgtctccagaagagacgtgtgtcccgagacacatgagtatcctccaaggcactggcctggatgagcagcatcgccttgagaattggggtagtgtggaaaggaagaatgaacaacggccctgggaagccttcccttcctgcagatattgttgggggagtgctggtctccattttgcgtttagaaaaccagacttagatgctggaggggcaccggttgtcttctttgaactcattccccgtaatgagctagaaaagagtacctaaccataggtattctctctagagactcatgtgtcccgtgggtacagtcaattcacagtatctgttctggcttttttcactttaattctgttctgcacattctgaacatatgcaggaaaaaaaatcattcctgaacttagcacaagctacactcgacacaacctaaattagtaaaaagcctttgatttattttgaagcaatttaactgtagacaaagcttgcatatatggaacagtattctcagagcctgagagttgttacagttgttctatttggaaattagaaggaattttttaataaggcacatttttcagtttcttacccattggtgtctattaagaatactatgtaatgttgaaatttccatcaaattaccaagcaaattactattaatgattagagatttagcctaacactctctctttgggccttaaatacccatttgtagttgtgttcgtgtcacttctgtctcagatgcctctgccaggacataatctctctaactcttgctagctggcttctccctcccacatgggcatacatgctgtgtatacacagagtacagcctgtgtacacagtagcagctgtcaacagggcctactccagatgggtggccccaggtaatcctctgctgtaaagtggctagaacaggctgtccctgcattaaaataggtgagaataaggaatttcgcctctgataataatatttattttcatgactttagagtaaccacatgatttgtaaacagttaaatgaagcagaggcctgagagagttgttggcatttgtctcacattaaatacattaaaattgctagatttgctattgtggttatgtctatcaaaactttaagaaaatttgtttaatgtactgagtttaactgattttctttggtgctgggaccaaattcttcacttctacaacactcaagagattgtcacaaaatattacaaaaatattgtttgttttgtggctcattaaaccctatataactaacagcttttaaggacattaacagaaatatatcttcagatggataaataagatagggacctattcaagacagcagcatttttgtattgtgatacctcccctaagttactctcacaataaaaccttatttgagaattttccttcacttcaatctgtgacatagcattaggcatttagtataccttatttgtgaaacctaaggttcattcaacagatgaagctgcaaaacagttttcttggtagactcttggaacttgctcagttttttccttactttacctgcatgacacacat

SEQ ID NO: 138565 - DNA, 14244 bp, Homo sapiens
  Payload ID: 7153
  Gene Symbol: GPRIN3
  Gene Name: GPRIN family member 3
  Uniprot ID: Q6ZVF9
  ENST ID: ENST00000609438
  CDS Start-End: 520-2850
aaagctgtcgcccctctctcggatgctcaggctgggcagcgctggacagatgggtacaccccgggcctgacggatgaacagtcgggcaagtgaactctcacctccaaactggctctgcgcccggcgggggcggcggcggcgtctgcagccccgcggtgggggcagccccctcggtctacgcccgactgctgcgcgccgcctctgctcttggcatagtaatttcagttcctgaacgcacggagctcgctccgggaccgggctgagaaggacctcagctcgcgggcccgccggagccatcggtgtggcgccgagagacggtgcttgggatatgcgacgggaagcccccgccacagcgcaggcagtggccccgccgcgccgcggagccgggcagagcaggctggttcttcagaggaatcatccctgactgtgtcatcactctgagctctgactgcgctcccctcccccaccagtgggaccagtactcaagagagctctggagtgctcctgaagagaaattccatggggactgtacctgaccctctgagatcagctaaaacttccctgattgcagcttccggaaaagaagacgatctaggagagccacaggctgcctcacctcggcatcgaccagctctcctgtgtaagaatgccaatggcttttcaggtgcccctgcagaaccagacctcagccccagggcagctgccgaagccctgatgcaggtttgtgagcatgagaccacccaaccagatatgtcttctcctggtgtgttcaatgaagtgcagaaagcacctgccacattcaactctcccggcaatccccagctgccagggagcagccagcccgcagcatcagccccgagttctgcagcaggaagggatcttatacacacaccattgacaatgcccgccaatcagcacacctgccagtccatcccaggtgatcagcccaatgccatcacctcatccatgcctgaagattccctgatgagatcacagagaacctcaaatagagagcaacctgagaaaccaagttgtcctgtgggaggcgtcctcagtagcagcaaagatcaggtgtcctgtgagtttccttctccagaaacaatccagggaacagtgcagactccagtgacagcagccagggtggtcagtcactcatcctctcctgtaggtggacctgaaggggaaaggcagggagccatctgtgactctgaaatgaggtcctgtaaacctctaactagagaatctggatgttcagagaacaagcagccctctgtcactgcctcgggcccccaaggcacaacttctgtgacacctcaaccaacccccctcactagcgaaccttcggcatgtcccccaggtccagagaaggtgccgctgccagcacagcgtcagatgtcaaggttcaaagaagccagtacgatgaccaaccaagctgaaagtgaaatcaaggaagttcccagcagggcttggcaagatgcggaggtgcaggcagtggcgagtgtcgagagcagatccgtctccaccagccccagtatcctcactgcatttctgaaggaaagccgtgctcctgagcattttgaacaagagcagctgcgtgtcatttgccacagcagtgggagccacacactggagctctctgacagcacgctagccccccaggagtccagccagtgccctggcatcatgccacaggtgcacattcaggcagctgcagctgagtctacagctttccaacgggaaaataaacttgcgagcctaccaggtggggtccttaaaacctcatcaatcaatttggtctccagtaatgcccagcatacgtgtaaagaagatgggaggttagcaggaatgactccagtgagggaagagtcaactgctaaaaagctcgcaggtactaattctagctccctgaaagctaccgccattgaccagatttctatcagtgcatgcagtcaagctgaaacaagttatggattggggaaatttgaaaccaggccatctgagtttgcagagaaaacgacaaacggccacaaaacagacccagattgcaaactatctgactcttgtggctctatcagcaaagctgatcattctgggagcttggatcccactaataaaggagatgcaagggaaaagaagcctgcatctcctcaggtagtaaaagaaaaagagtctactggcactgatacctcggatgccaaaaccctactgctcaatcctaaatcccaagaaagtggaggcacagaatcagctgctaatcctacaccctccccaattaggaagaaccaggagagcaccttagaagaaaacagacagaccaagacagccaccagcctgagcctgccatctgatcccatgggtgactccagcccaggttctggcaagaagaccccatctcgctccgtcaaagccagcccacgcaggcccagccgcgtcagcgagttcctcaaggagcaaaagttaaatgtgacagcagctgctgctcaggtaggactcactccaggagataagaaaaagcagcttggcgcagactccaagctccagctgaaacagtccaagcgtgtcagggacgtcgtgtgggatgagcagggaatgacctgggaagtgtatggtgcatccttggacgcagagtccctgggaatcgcgatccagaaccatttgcaaagacaaatcagggaacatgagaaattaatcaaaactcaaaatagccagacccggagatccatttcctcagatacttcttcaaataagaagctcagaggaaggcagcacagtgttttccagtccatgctgcagaacttccgacgccccaactgctgcgtccgtcctgccccgtcttctgtgttagattgaaagggagtatttatgggagtttgtgtataaatttacggtattcacatgcgtccctctatgtcaaagcttgcttagttttttgctgcaagactaggaagaaaaagcaagtattcactataggaaattgctattaaaaattgttagatcctttgacctggagctctataaacaaaaatgtcatttcaatttgaaagaaggaacaagaaaagagaaacaagcttcactgaaggtttgcaaccttaacaaattgaaaataatactcactgggtttttaaaaatatgatgttgttcatagaaatagcattattgtatcattatacatgtattattttgtataactgcctcaatttatcacacagtagtagttccattaaaatccctgcttcatattgaaagtagcaaaaacactattggcgaaaacattgttataatttctagtcttattgcagtaagaatgctgtaaccacacaaattataaataggtgataagaaccataatgaaaaaaatgagaacatatttgattcattcctaggccagataacattaaataaaaacagttaaatgtgtaaaatatgaaatatgaattaatgtttataaacatctgcagacaactctttttataaaccttcttattgctgttaataaatataagaaagttatattaggaacattagctaagcttttgactatgaaaactgcctacattaaacatggatttatatagacccattttcctgcactgaaggcaaggcgcatctctgtgattctgaccagacatattcatattttcttaccctagaggaagtacatgggactgaattcttgaaaagagccatcaaattagggataatactaaattgatactgtgcaggtgttctccagtgatattctactgagaatgctaaggttctggtcaggaactataaatagcagattaccaaacactgctttttctgtgatgataaaagcctcataagtaacaaaaacaatgtttaatttagactcctgtaaacaggatgcaattagtgattttttttaattgggttcagtaacttccagtaacaaatgtagtcaacaccaaattagaatgtgagcttccttacaatttttgtacatagactactatcatctaattgcttaaatatatatgctggagtaaaaaggtaacttctgcaaacttattgattttaagagaaatacccataatatccttcaaacccaatgaaagaagaggcctttacgaaaacatggcttgtgatttgggtggattatacttcctgggaccttggccctcccgtgtctccagaagagacgtgtgtcccgagacacatgagtatcctccaaggcactggcctggatgagcagcatcgccttgagaattggggtagtgtggaaaggaagaatgaacaacggccctgggaagccttcccttcctgcagatattgttgggggagtgctggtctccattttgcgtttagaaaaccagacttagatgctggaggggcaccggttgtcttctttgaactcattccccgtaatgagctagaaaagagtacctaaccataggtattctctctagagactcatgtgtcccgtgggtacagtcaattcacagtatctgttctggcttttttcactttaattctgttctgcacattctgaacatatgcaggaaaaaaaatcattcctgaacttagcacaagctacactcgacacaacctaaattagtaaaaagcctttgatttattttgaagcaatttaactgtagacaaagcttgcatatatggaacagtattctcagagcctgagagttgttacagttgttctatttggaaattagaaggaattttttaataaggcacatttttcagtttcttacccattggtgtctattaagaatactatgtaatgttgaaatttccatcaaattaccaagcaaattactattaatgattagagatttagcctaacactctctctttgggccttaaatacccatttgtagttgtgttcgtgtcacttctgtctcagatgcctctgccaggacataatctctctaactcttgctagctggcttctccctcccacatgggcatacatgctgtgtatacacagagtacagcctgtgtacacagtagcagctgtcaacagggcctactccagatgggtggccccaggtaatcctctgctgtaaagtggctagaacaggctgtccctgcattaaaataggtgagaataaggaatttcgcctctgataataatatttattttcatgactttagagtaaccacatgatttgtaaacagttaaatgaagcagaggcctgagagagttgttggcatttgtctcacattaaatacattaaaattgctagatttgctattgtggttatgtctatcaaaactttaagaaaatttgtttaatgtactgagtttaactgattttctttggtgctgggaccaaattcttcacttctacaacactcaagagattgtcacaaaatattacaaaaatattgtttgttttgtggctcattaaaccctatataactaacagcttttaaggacattaacagaaatatatcttcagatggataaataagatagggacctattcaagacagcagcatttttgtattgtgatacctcccctaagttactctcacaataaaaccttatttgagaattttccttcacttcaatctgtgacatagcattaggcatttagtataccttatttgtgaaacctaaggttcattcaacagatgaagctgcaaaacagttttcttggtagactcttggaacttgctcagttttttccttactttacctgcatgacacacattgggttgaaagttgtttggttttacccttcatttctcttagatatgatttggttctttttcatgcattatatttttgaaatatatggaggaaatattttattgaatcaagaaatagaaaatattccttaaaccagtagtaaaaaggtgagttagaactccatgtctggaagacaattcaacatttaaaatattaagatgctataccacttaacaagtgaatactaaaatttttaatttaaagattgattgttctgtttttatgaccatgagaaaaatgtgacagcttcagctgtcatatgtttatcttgaatgcttttctaattatgtatttctggattattgactttgaatgccacagaccaactactttacatagagtaaaatattgattaacctttgtgctttgggtcactggcaaaagttgaacatcctgataagtcaatgttaaccagaaacctttttgttcacgtctgaaattgaatatttataaaatgtgttagtatgtttcctgccttgataagttcacctatattgaatgtaatttgatctttgataattttttttaatcttgagaattctctgatactgttttgaataccagtgttcaccatgttataaagttaaacataaaaattgaaataaattgaactaaatatgcatgtgtaacatataccttagaggttggatttcagaaccaaattcataataggagcttgctgtcttaaagtagaaagcagaagaggaaaatagcatttgtttgtattctagcatattgaggtttcactgttcctagcttatactaatgtttttcctctcatttctgggaatgcctgtcattctgagaatccctatatatagcataccaagaacagagtatgatgttactttaaaatgtgtttacagaggatatatgcaagtgtgctgttaatataaattgtttgtccttttctgcatccactttgttactgttttgctgccaaaatgtgtgaaatgtgtgtcttctcttcctcctacatattgtgccaagtgtttaaaattttgtctactcctagtaacacataattaaccacatcccttgtctacttttatgaatcagtataaagaaaaacaatacattaggataaggtttgcatatatgtatatgtgtttttattgaaaactgggcacttgtagccttgtgtagacctctacctgcctgatttactaattatctgtaatgctgccatggagatgatgctgtttactctctcctgctttgttctaagtggtgtttgagaagtgaggcctgtgaatttccctttgtggtagaacagtgaactcagcagtatcttgcataagtgagccgactaccttattcccactctgtttttgtgtacatggtgaaatcagaagtcaaacatcccctttagtgtttgttattttacatatgtatctgagcattttgttttctgttagcaatgcttcctgatgttgtgcgtggccctttttggttgattctctccaaattcgggtcagctgctgccacctggcaaataacagaggatatgctgaatctcctgtccatccttgtaacgatatccttcttaatgaaattcttcaactggctgagcaattacaaatgtcatctgtccagacacatgggcttaaggatgtctacaaaattttagacatttttgcaaatgggaaaaaaaatagtcttgtaaatactgaaacagatttccatgaactttatcctactcttggaaagaaaacaattctccttggctgcagaaatcaaataagctgggtttgcaatgaccaaggacataaatgaagatggattgaagtggaaaaattctgtctcccaagtgatcagtgacatctgccagaggtcattacagctacttttaactgtgaacagtcaccagctaaactactcacttgccacaacaaaataacctctctcaaaataaatccagtgcatctgtatatatgtgtagatagcagcaacaaacaatcctgaaacattatttttggctgttaggtaagtaaacgtgatgataattataaacaacattcaaataaccttggaccttggtgaaatgacttgtggtggccagaatggtgcaacaagatgttatttgcaagtttttttaagacacaaatatctcagatactaataatgagaataaagactgttgaatatgaaattaaagccaagcaataatgtgccaaaaagaggcagttataccagcaaatgcatctattatgggcacaccattatataatgatggtttgctttatgaagactgactgtaacccacaggataaaataagcaaaggcatagtttctgctttcttcctggaaaaacttgtttagaagcttcataaagaggtacagcactaatgagcattagtcaggatacagttggcatctatgtttttatgtgagcccagagggaagaggagccactcaaagtcttgctggcttaaaactcaagacagctgcaaccagaagttttgttgaaatggagactttaaacttatggtaattactctttctggacactagcatgtagaaagcaattcagttaactctgcccagaggattaccagctttagctgtgaaaaaatgggctcccggatgtaaaatcactaaaacatgagatcttgtatccaaagaggcttcaaatgatgccttacagaaaacgatgctccagatgggcacttctaaatgctaactcttcatcaagtatctttctggattcaagctcaaaattaattggctgcaaaatagtaggaataaaaatcacatattttacactttagaaaaggatattgatgatcaacctgcatggtgataattatgatgagataccccagtgatttaatgatgttagaaagaattaaatgggagagaattgctaacagctttcttgatctcttaactatggagatgtcattcatttatttctggggtgaaaattatagcttgctttttgacattgctgctagtattgttctttgttgctttaaaaattgtctctctttagaaaaactcttgagcagttaaacagttttttttctgattcatatcattgcttttaataacatgtaaaggctgtgtgtagagcaaactatataaaatgagtagaaagggcttactcatgttaattggcatccttgatgattttagttgagattccttaacatttattttagatcacatctttacgtaacttatttttcctaatgttttccatcgtgtcttaaaatgatgctggtatatcaggagattgcagtattatagtcatactccccaatccctagaggagaggaaagactaattcttgttttaagggcccctggagataccttttattaaggttgaaaaaggtcaacacagcctgaaaataagaaaaatatatactagcaattactaattttctaaatgtgtgtatctctgctgtactaatgtgtgaacaatatgtcgtgcataatactgtagctggtcgtggtatgtcaatacattctgtgagtgtgtacagtctgagtgatcagttttctatttttatgtgtaaaaaaaataacttgtcgtatcccatttaaaggccaatttctgtattcaggcaggcatatgtacatacatgaataaagccaacaaaagtgtgcacatgtattcagtaacagaatttgtccttttatttttgaaggtcagaaagggctgtttgatttgtgttttttttttatcatctccttgagtaggtaacataattatcacaaaggctgaatatagtaatcagtacattggcatattattaaatatgccagggctaagtaaccatgccattagtcacaggtaaggtcagttctttgaccactgggataatttacattcctcacacatcctctccgtgttaagtgtgtgactaggatgtacatactatgggtgtgattgtgtacataccttgtatgaattatctaaatcctcaaagcagttgcaggaaagaaggaagatgaaacagttgttcaaaagcctcaaaagggctaatcaatatatatttttcattttctacacataaaaatgtaaatagcttatccacatatataggcacacataatacattttatttatactagtatattcagataaatcacaaattaaaaccactaattgaaagttgcatatttccatgactgctctgttttacaaatattattattgaatgagatgcccccccaattaatggtgttactccctggtagcagattttgtgcttagaaaactccagcaactgaagcacagactggtaactgagtagctacagggaattaatgcttctctttaagcacctaatttcatatctggaaatggcaaacagggatgaaaatcgattatgttttggagactccttttggacatgtatcagtgtgttgatttgcacaaaccaataaaagccctacattttttggaaatggatccctagatttcaagcatgtataatcactcaaagtggatatgatcacaggcattcttctcttgagctcagcaaaactatgcctaccaacaccgaagagaagtcaaagatttaaatgaaaaaaaattgcagatgatgttggtgagataataggatatgagcaatgaacccttgggtggggttccagggcacttaaattgcctcgtgtcttgagttccttaagatggactcaaacaaaaaattagtattatcaataacaggtaatactgtgtggattctaacaacattagaatcattagctggcaagtgtcaactctgaacaagatttgtcagcttatcataattccaaccagttaattgatattgttcgaatttatctcattttttctcaaaggaagtgctctattagggatcaaaaagtctcacctggttcttaaaacctaacacaatttgaccttgaatcctcgacactaaaaattacgttggttgggtatcagattgaaaatatgcatggaggctgggcgtggtggctcacacctgcaatcccagcactttgggaggccaaggcaggcagatcacctgaggtcaggagttcaagaccagcctggccaacatggcaaaaccccgtctctactaaaaatacaaaaactagccgggcatggtggtgtgtgcctgtaatcccagctactcgggaggctgaggtgggagaatcacttgaacctgggaagcagaggttgcagtgagccaagttcgcgccattgcactccagcctgggagacagggcaaggctctgtctcaaaaaaaagaaaatataaatggaaataccagaatcaccccttgatagagaattccatttggcaaagtacaaacaaccacttctcagtagaaagttaagaataacatttaaaaacatattcatgttttagagaacgaatgtgccatcgttgtatattaaataaaaataaaagattaaccagctataagaacactacaattacaactagagtggcagtgttttttaactaataaaagtatacatgtttataagtgcagcatacctgaaatcttgatgtttgtcaatacttatggttgcttcaaagataaatttatgtgattatttttgaaagatgtgtattaatttgaataatacccagaaaaattataacttaaaaattgcagttttcaatatgagaatcatttatgtgtgtaaatactcaactaagaaagatcaaaagtgtggtataatattacaagaaaaaatattcaaaatggaaagtccatttatgaatgtattaatattaaaatccaaagttatgtttttttataatgtctacattataatgtttacaaaggccataaaatcatttcagaaagttctcatcctccagatattgaccaataaaacttcatttcctagaaaaaagaagaaatgttataatttatacaaagatgaagtaagattttggaattacgtatacttacaccttcattttggatttgatttttgaatggatgcttaaaattctgatattcaactaatgacttagttttaccatcaaaaaatttagattatgatttttttgcatctcacttttcataataaatgtaatatagatacaatttattctgttttttgttgatgttattattgtttccactgctattgaaatcgttcttttaaccatgaatgtgcagaatcagttgattttccatgtgacagcttctgctaggaatctgcagtggaactggaagtatttgcaatgaaagaacttttttctttaattaaaatagaattcccatagaatcaacaattcctcctggtcatcaaacgcgaggtttttcctgtacttggtagagcagagtgtgtgtgtgtttgtgcgttgtgtgtgtgttgtttggtgagaatgatgagagctgagcattgtgaaaatacaggcgggggtggggtaacagagctgggtaggggtccagggcgcttagattgccttattgtccaggcttagatgcctcttacccagagccatcaggtgtaccctatatagctccagcctttctgcctactcctgagaagataaactgggatcctgcagtctggattcctagaaggagatggaaagcccagccatatccccagtttgacttgaccagtagtaaaactagcactacagtttgatccctttttacctccttgaatatcttcaattcatcaaggatctgtaaagaaggagaggtacaagatatatgaaacccaaatctcaaaacaatgatttagtgaatttcccatgaactttaaacagtgattgcttcaaaatttccaagagccatactctccctccagctgctgtgtgtgtgtgtgtgtataaatgcacactattttaacctaaaatggtgccctgtggctgccattctctaactcttgcatacttaaacatttattcttggtcaaattaaaacctcatgcatttccaaagatataaatgccttgcctggagaagttagatcttgcaagtctcaggagggccgagatggtttgtcttatgcctatagctgtttatgtcccaccagtgggtgtttgtttcattaggtgccgtttccagccaaatgttctcattcttcacatcttcaatgttgagtagcaaacagaagaacatccttcttagcataatattgcttcactggactgattgtgaactcaaaatacctcttgtttcttgtgaagggtttgccttttgtaaacaatataagatcacttttggtcaaccaccctgtctgaatttatctgggctgctataataaagtatcataaactgggaggcttgtaaataaatttatttcttacagttttggaagctgggaaccccaaaatcaaggccaatttggtgtctggtgagggcctacttgccggctcacgtgtggtgcctgtttgctgtgtcctcacacagtaaaagggatgaagtgtcccctcccgggccactttcaaaagggcactaatctcactcatgagggctctgtgaccaccatctaatcaccacccaaagcccccactttctaacaccatcgccttaggagttcagacttcaacatgagttttggagggatacagacatttagaccatggcatacacattcttaatgaacttctgaatgccaccattattaaattttcttcaacaccattctacacaaccactgagctaattgacagagttctaaaatgtttagacccttgtaactaccttagcaatgttctgaagctggtttttctaaatatatcacagaggtctaacatagttgaaattcaaattgtctggatggaagctgaaagtgcttgcagagatttctggtgggagtactggcatctcaagaatggtatttccctacaccttttttagtcccgcttgacgtctctcaatcaaactgcaaaagagccttgacctgccattaaaaataataataagcagaatgtcattgccaaagattattataggtgtttaaaagcaagataagacttcttaaagggctccaaagcatttgcttgttatctatgtttttttagcccaaagccaaaacaaaaaataatgcctttgtgccagacgttttgctgggcacttccatctatgtctcaaccttaggaggtataatgtatacatgcacagttttacaatttgtcaatggcacagatacttgagacatataaattggatgatcacagagatattgtggtaaatatctgggcttggaatcaaaggaccctgggttcaaatctcagcttcgaatcaaagaagctaaattctttggctgagtaaaccaaaacacctcccaccagaccccacctccaaatttcaacatgaaatttggagaggataaatatccaaattatttcagtgcattcatctggaaactgagaataacaatgctcactttgcaaatttgtgggaattaaatggcataggcaaaatattgttcttttcttctcttactcctctgagttttgctttcttccacttgaactttaccactcaattgttaaaagccttgaattttgccattgtattctatttaataaacttttgataaatctggataaataa

SEQ ID NO: 138566 - DNA, 2114 bp, Homo sapiens
  Payload ID: 7154
  Gene Symbol: GPSM1
  Gene Name: G-protein signaling modulator 1
  Uniprot ID: Q86YR5
  ENST ID: ENST00000291775
  CDS Start-End: 233-733
gtgacacgttctgggggaggggtagccgacagggggcaggttagagtcccgatcttggccagggtctcagaagtgtgtgtggcctgggcaagcagcccccggtctcgtctgggggtctgcggggctagctttggctgcggtgaccccactccctccccagagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgag

SEQ ID NO: 138567 - DNA, 3345 bp, Homo sapiens
  Payload ID: 7154
  Gene Symbol: GPSM1
  Gene Name: G-protein signaling modulator 1
  ENST ID: ENST00000354753
  CDS Start-End: 1-1960
gatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggcgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggcccggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 138568 - DNA, 1111 bp, Homo sapiens
  Payload ID: 7154
  Gene Symbol: GPSM1
  Gene Name: G-protein signaling modulator 1
  Uniprot ID: Q86YR5
  ENST ID: ENST00000392944
  CDS Start-End: 288-788
ctgtgtagggcatggacacagggagctcatggcagggctgacacagggtgtggtgggcacagggacaggaggcacgggaggcttcccgggatgtctgggaagtgttccaggccaaggctggggaggctggcccagggcaggtgacggacagaggcctggactggggtagcacccatgagaggggagaagtccggggcagtcggcgggtgccgaggagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgc

SEQ ID NO: 138569 - DNA, 2057 bp, Homo sapiens
  Payload ID: 7154
  Gene Symbol: GPSM1
  Gene Name: G-protein signaling modulator 1
  Uniprot ID: Q86YR5
  ENST ID: ENST00000429455
  CDS Start-End: 172-672
ggcggtggtggccctgggcaccttgtgtcctgcctgcgctctgtgtggccaagcacccagcgtggctccctgctgctgtggagacagcctgtgatccgcagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 138570 - DNA, 3633 bp, Homo sapiens
  Payload ID: 7154
  Gene Symbol: GPSM1
  Gene Name: G-protein signaling modulator 1
  ENST ID: ENST00000440944
  CDS Start-End: 221-2248
gcgcgggcggcggtgacatcacggccacggcggcgggaggggcggcggcgccccgcgcacatcacttcctcggcgcctccccgggggaggacgggcgaacgaggcgcggacggacaggcggacagcagggcggacagcagggaggacagcagggcgggcagggggcggacggccacggcgcggggggcgctcccggctcccgctcccgcgtccccgacccatggcgggcccggccccgcccgcggccgacgagctcccgggcccggccgccaggcgcctctactccaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggcgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggcccggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccacggccgcccccaccctggaggacaggatcgcccagccctcgatgacggcctcgccccagaccgaggaattcttcgacctcatcgccagctcccagagccgccggctggacgaccagcgggccagcgtgggcagcctgccggggctgcgaatcacccacagcaatgcagggcacctccgaggccacggcgagccccaggagccgggggacgacttcttcaacatgctcatcaagtaccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagggcaccaagttcgggatcctaggactggcaggacctgctggagcctgagatgggccccaggggcctgaggttgcctcctcctgtccagacccagccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggccgcacccgagagcagggacaggtgcccgaacacagggtctccaggacgtagcgcccccccgcatacttgaatgtatgtgcgtatttattgctcacgtctgtgccatgttgtcaatgggtcctttccaacccaagaggtacatttgtttttctgtttttcctgaaaaataaagtcggccaagtgagtgtg

SEQ ID NO: 138571 - DNA, 2270 bp, Homo sapiens
  Payload ID: 7154
  Gene Symbol: GPSM1
  Gene Name: G-protein signaling modulator 1
  ENST ID: ENST00000616132
  CDS Start-End: 221-1594
gcgcgggcggcggtgacatcacggccacggcggcgggaggggcggcggcgccccgcgcacatcacttcctcggcgcctccccgggggaggacgggcgaacgaggcgcggacggacaggcggacagcagggcggacagcagggaggacagcagggcgggcagggggcggacggccacggcgcggggggcgctcccggctcccgctcccgcgtccccgacccatggcgggcccggccccgcccgcggccgacgagctcccgggcccggccgccaggcgcctctactccaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggcgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggtgagttccagggttgtgggggggtcttgctccccacaggcacggaccgcatcaggagctgcggaggggtgggatcgaggccaggccagcatggcggaggtggcagccgccagaaaatggcgcctacaagccagttcttcttggcctcagggacagcacaggcctgaggttcaccctgagcccttcccacccgcatcctgagtggcgctgcagggctgctggatgaaggacaggaggtggtcgcctgttgccccactggctgctccagggcctccacccccacctccccctggagccctcggtgcagggagggcttctgtcctcagacccaagtaggagagggctgctgggaggcgagagggcatcagccagagggctgggctgggctgggctgggctgggctgtgggagccctatgtgcctggggcagtaatcaggcaaggcccaaggccatgcgaggccaccgtggtgacctcattcatggaccgctggtcgtcccatgccggtcagcagtgctgcagacacaggacagaacgtcccctgcaaagcgaaaagactaataggtgccaggggggtggtgccaggttgggccgacttcctgaggtggctggcaggtgggtgaggggcaggcttggggggagcagctgccccacccatgtgtcccccactcccaaaggtcttgagtttgccagcccccgagaagggatgcctgcctcccagaacgtacctggtgccccccaggcctgctaaggaccaggctgggaacaccaggcttggatgtggtgctgggctgccggagtttctttttcttatcttatttttaataattaaatgtttttataga

SEQ ID NO: 138572 - DNA, 3032 bp, Homo sapiens
  Payload ID: 7155
  Gene Symbol: GPSM2
  Gene Name: G-protein signaling modulator 2
  Uniprot ID: P81274
  ENST ID: ENST00000264126
  CDS Start-End: 497-2551
aggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctcc

SEQ ID NO: 138573 - DNA, 7433 bp, Homo sapiens
  Payload ID: 7155
  Gene Symbol: GPSM2
  Gene Name: G-protein signaling modulator 2
  Uniprot ID: P81274
  ENST ID: ENST00000406462
  CDS Start-End: 774-2828
aaagaagataactcattcaaggtcaatcagcaatgtctgaagaagaaagaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatctctactaaaaaatacaaaaattagccaggcatggtgatgcacatctgtaatcctagctactcgggagactgaggcaggagaatctcttgaacctgggaggtggaggttgcagtgagccgagattgtaccacctcactccagcctgggtgacagagcaaaactctcaaaaaaaagtaaaatttcaaaaaagcttcacaatataaaccttaattttaatgacatattggctagtcaataaacaagtcttatctcatctcatctcttttctgataacaaacacccgatgtgttcaatttgctttcatatttaagtctttcctgaattgctgtcatcattcaacaacagttgcatgtcgccttgctagctgtcaaagtagacttcatccccaaatggatatctgtaatgaaagaatacaaaggtgaaattttatttaaaaattttttaaaagaatttggttttggattaaaaggcatgcaagcagcattaattccactcacagttacagtctatcacctggggcattcactacttttcagagtcagatcacagttcaaaagacagctctcaccttgggggcatattccccaagtcagtgtgaacatgtcttgtcccaagaggacactttatacgcatggatgttcacaaatttattctaaactgcaggtgtctgtcaggattcatttgttaaacatgtcctctgtgttaaaaatcctaaaatccttttgcatttcttagaaaaaatcacgtttctgatgaaattctaaagatgtttgcaatattaaactagaatatattaacatgtataattttgagacaaggtcttgctctgtcacccaggctggagtacagtggctcgatcataactcactgccacctcacgatcctcttgcctcagccctccaagtagctgggactacaggcgtgtaccaccatgcctggctagttttatttttagtacatagccttgaacaactgagcttaagcgatcatcctccctcaaccttccaaagtgctaggactgtaggcatgagccactgcacctggcctaaaattacattgttacaggcacgtaagtaacacttcctggatccaaaaatgtgtattctgcatttcaacaactgaacttaagcgatcatcctccctcaaccttccaaagtgctaggactgtaggcatgagccactgcacctggcctaaaattacattgttacaggcacgtaagtaacacttcctggatccaaaaatgtgtattctgcatttcaacaactgaacttaagcgatcatcctccctcaaccttccaaagtgctaggactgtaggcatgagccactgcacctggcctaaaattacattgttacaggcacgtaagtaacacttcctggatccaaaaatgtgtattctgcatttcatattaaaataaaaaagcaagtgcttgggatacaaatatctgcatgaaaatttaaagactttattcctgactggtatcacttttagtaagcagttgaacataacttgtagtgtgaatatggttaaaacaaaggacacctgatgtctgtgaagtctgctaaggacaggtacaaaatttatgcattgctttttaaaaagtttaaaatgaggaatgcttttgataatcagaaagactaatgtaaagtgctgactgatgtcctgtctgcagttaaggaagacacccaactctcttcttcctcatcatggtattctctatgtatagatctctaaaaatgcaaacttcctatggacaagacaatatgatttgctataatatgaattaagatatggtaatatctaatagtctccactgctaggattctgagtaacacaaaaaataggttttataaaaagcccatgcacttcaattggtgggggaaaagaataaagtcattttcagtcgactgactctgtaaaacagattaccaatataacaagctatgttatctaaattgccctggcagtcttcagttttctctaagtaaacaaagtaaaaggaacaataaggatgcaggcgtagtaatagctgtggaaaagatgaaactacagccacagtgacctgtgggcagcctgcgtagagataagctgaggtgtcagtcagactgatcctggtaacgatactccatggctgcatgaagatgctggaggcatcaagtgggtggccttaactctagtggattcactaggcaatgtaaattggttagtgggttcccgtaagtgcctgtaacaataaaatttctttttcaatgtccccaattcaaactggcctccttaactatccagaatcagtgatgcctgtcatctgttcatcttaaaataaacacttcttactttatgggatgtaaatatcaaagagaagatgaaatgaaaagcttttacatatataacgtgtttgttaattctaattgtcagtaaaaatgtgaatgttgaagttgaaa

SEQ ID NO: 138574 - DNA, 731 bp, Homo sapiens
  Payload ID: 7155
  Gene Symbol: GPSM2
  Gene Name: G-protein signaling modulator 2
  ENST ID: ENST00000441735
  CDS Start-End: 1-653
atatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaagtatgtctgtatatttttttcgttctgcatacagctcagataccactgaaaacattggtagtgttataattctcattcaggaagggcttattttgtattagagagttattattgtccatcattcagtaaaaaattattgaacaccga

SEQ ID NO: 138575 - DNA, 571 bp, Homo sapiens
  Payload ID: 7155
  Gene Symbol: GPSM2
  Gene Name: G-protein signaling modulator 2
  ENST ID: ENST00000446797
  CDS Start-End: 416-571
gcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaataaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaa

SEQ ID NO: 138576 - DNA, 992 bp, Homo sapiens
  Payload ID: 7155
  Gene Symbol: GPSM2
  Gene Name: G-protein signaling modulator 2
  ENST ID: ENST00000435475
  CDS Start-End: 768-992
aggcgtttgaggggctctcggagggaggtgacagggaggggtgcgtgtgcgtgcgtgtggggcttctgtgtccagaggtctgggggtgacgtcctttgttttgggcaggaggcgggctgggggcttgcgggacctgtgggcgctgcggggacgcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaatgtgagtaacaaattgtgaatcaaagcccgaatccccgtggaattcattccgaggctgattgcaatcacttggagtcgggcgcgtcctacctaaaccaggcagtttatggcaaatacctgccttgaccgtgcttaaattagtgaacttttgggcaccaactggtcgatttaccatagaaattggtagttgctgcaaaaagaaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttg

SEQ ID NO: 138577 - DNA, 904 bp, Homo sapiens
  Payload ID: 7155
  Gene Symbol: GPSM2
  Gene Name: G-protein signaling modulator 2
  ENST ID: ENST00000435987
  CDS Start-End: 265-904
aggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacc

SEQ ID NO: 138578 - DNA, 1476 bp, Homo sapiens
  Payload ID: 7156
  Gene Symbol: GPSM3
  Gene Name: G-protein signaling modulator 3
  Uniprot ID: Q9Y4H4
  ENST ID: ENST00000375040
  CDS Start-End: 394-876
gaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138579 - DNA, 1456 bp, Homo sapiens
  Payload ID: 7156
  Gene Symbol: GPSM3
  Gene Name: G-protein signaling modulator 3
  Uniprot ID: Q9Y4H4
  ENST ID: ENST00000375043
  CDS Start-End: 374-856
ccggagcggggatcacctcaacttgactgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138580 - DNA, 1476 bp, Homo sapiens; identical to SEQ ID NO: 138578
  Payload ID: 7156
  Gene Symbol: GPSM3
  Gene Name: G-protein signaling modulator 3
  Uniprot ID: Q9Y4H4
  ENST ID: ENST00000383265
  CDS Start-End: 394-876

SEQ ID NO: 138581 - DNA, 1456 bp, Homo sapiens; identical to SEQ ID NO: 138579
  Payload ID: 7156
  Gene Symbol: GPSM3
  Gene Name: G-protein signaling modulator 3
  Uniprot ID: Q9Y4H4
  ENST ID: ENST00000383269
  CDS Start-End: 374-856

SEQ ID NO: 138582 - DNA, 1476 bp, Homo sapiens; identical to SEQ ID NO: 138578
  Payload ID: 7156
  Gene Symbol: GPSM3
  Gene Name: G-protein signaling modulator 3
  Uniprot ID: Q9Y4H4
  ENST ID: ENST00000429209
  CDS Start-End: 394-876

SEQ ID NO: 138583 - DNA, 1456 bp, Homo sapiens; identical to SEQ ID NO: 138579
  Payload ID: 7156
  Gene Symbol: GPSM3
  Gene Name: G-protein signaling modulator 3
  Uniprot ID: Q9Y4H4
  ENST ID: ENST00000441705
  CDS Start-End: 374-856

SEQ ID NO: 138584 - DNA, 1456 bp, Homo sapiens; identical to SEQ ID NO: 138579
  Payload ID: 7156
  Gene Symbol: GPSM3
  Gene Name: G-protein signaling modulator 3
  Uniprot ID: Q9Y4H4
  ENST ID: ENST00000448684
  CDS Start-End: 374-856

SEQ ID NO: 138585 - DNA, 1476 bp, Homo sapiens; identical to SEQ ID NO: 138578
  Payload ID: 7156
  Gene Symbol: GPSM3
  Gene Name: G-protein signaling modulator 3
  Uniprot ID: Q9Y4H4
  ENST ID: ENST00000414839
  CDS Start-End: 394-876

SEQ ID NO: 138586 - DNA, 1456 bp, Homo sapiens; identical to SEQ ID NO: 138579
  Payload ID: 7156
  Gene Symbol: GPSM3
  Gene Name: G-protein signaling modulator 3
  Uniprot ID: Q9Y4H4
  ENST ID: ENST00000445326
  CDS Start-End: 374-856

SEQ ID NO: 138587 - DNA, 1456 bp, Homo sapiens; identical to SEQ ID NO: 138579
  Payload ID: 7156
  Gene Symbol: GPSM3
  Gene Name: G-protein signaling modulator 3
  Uniprot ID: Q9Y4H4
  ENST ID: ENST00000457070
  CDS Start-End: 374-856

SEQ ID NO: 138588 - DNA, 1476 bp, Homo sapiens; identical to SEQ ID NO: 138578
  Payload ID: 7156
  Gene Symbol: GPSM3
  Gene Name: G-protein signaling modulator 3
  Uniprot ID: Q9Y4H4
  ENST ID: ENST00000424520
  CDS Start-End: 394-876

SEQ ID NO: 138589 - DNA, 1456 bp, Homo sapiens
  Payload ID: 7156
  Gene Symbol: GPSM3
  Gene Name: G-protein signaling modulator 3
  Uniprot ID: Q9Y4H4
  ENST ID: ENST00000420041
  CDS Start-End: 374-856
ccggagcggggatcacctcaacttgactgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccgtcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138590 - DNA, 1476 bp, Homo sapiens
  Payload ID: 7156
  Gene Symbol: GPSM3
  Gene Name: G-protein signaling modulator 3
  Uniprot ID: Q9Y4H4
  ENST ID: ENST00000453667
  CDS Start-End: 394-876
gaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccgtcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138591 - DNA, 1476 bp, Homo sapiens; identical to SEQ ID NO: 138578
  Payload ID: 7156
  Gene Symbol: GPSM3
  Gene Name: G-protein signaling modulator 3
  Uniprot ID: Q9Y4H4
  ENST ID: ENST00000432871
  CDS Start-End: 394-876

SEQ ID NO: 138592 - DNA, 1460 bp, Homo sapiens
  Payload ID: 7156
  Gene Symbol: GPSM3
  Gene Name: G-protein signaling modulator 3
  ENST ID: ENST00000474364
  CDS Start-End: 387-860
ccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagaatggacatattttggcatcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138593 - DNA, 1417 bp, Homo sapiens
  Payload ID: 7156
  Gene Symbol: GPSM3
  Gene Name: G-protein signaling modulator 3
  ENST ID: ENST00000473977
  CDS Start-End: 373-522
gggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138594 - DNA, 1417 bp, Homo sapiens; identical to SEQ ID NO: 138593
  Payload ID: 7156
  Gene Symbol: GPSM3
  Gene Name: G-protein signaling modulator 3
  ENST ID: ENST00000472768
  CDS Start-End: 373-522

SEQ ID NO: 138595 - DNA, 1460 bp, Homo sapiens; identical to SEQ ID NO: 138592
  Payload ID: 7156
  Gene Symbol: GPSM3
  Gene Name: G-protein signaling modulator 3
  ENST ID: ENST00000494847
  CDS Start-End: 387-860

SEQ ID NO: 138596 - DNA, 1417 bp, Homo sapiens; identical to SEQ ID NO: 138593
  Payload ID: 7156
  Gene Symbol: GPSM3
  Gene Name: G-protein signaling modulator 3
  ENST ID: ENST00000476582
  CDS Start-End: 373-522

SEQ ID NO: 138597 - DNA, 1417 bp, Homo sapiens; identical to SEQ ID NO: 138593
  Payload ID: 7156
  Gene Symbol: GPSM3
  Gene Name: G-protein signaling modulator 3
  ENST ID: ENST00000478656
  CDS Start-End: 373-522

SEQ ID NO: 138598 - DNA, 1460 bp, Homo sapiens; identical to SEQ ID NO: 138592
  Payload ID: 7156
  Gene Symbol: GPSM3
  Gene Name: G-protein signaling modulator 3
  ENST ID: ENST00000479498
  CDS Start-End: 387-860

SEQ ID NO: 138599 - DNA, 1417 bp, Homo sapiens; identical to SEQ ID NO: 138593
  Payload ID: 7156
  Gene Symbol: GPSM3
  Gene Name: G-protein signaling modulator 3
  ENST ID: ENST00000481251
  CDS Start-End: 373-522

SEQ ID NO: 138600 - DNA, 1460 bp, Homo sapiens
  Payload ID: 7156
  Gene Symbol: GPSM3
  Gene Name: G-protein signaling modulator 3
  ENST ID: ENST00000472154
  CDS Start-End: 387-860
ccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagaatggacatattttggcatcagggcccccctcaggatgaggaaggctggccccctccaaactccaccactcggccttggcgatctgctcctccgtcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138601 - DNA, 1460 bp, Homo sapiens; identical to SEQ ID NO: 138592
  Payload ID: 7156
  Gene Symbol: GPSM3
  Gene Name: G-protein signaling modulator 3
  ENST ID: ENST00000472817
  CDS Start-End: 387-860

SEQ ID NO: 138602 - DNA, 1417 bp, Homo sapiens
  Payload ID: 7156
  Gene Symbol: GPSM3
  Gene Name: G-protein signaling modulator 3
  ENST ID: ENST00000496307
  CDS Start-End: 373-522
gggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccgtcccctcctcctccagggacccgccacacagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 138603 - DNA, 1460 bp, Homo sapiens; identical to SEQ ID NO: 138592
  Payload ID: 7156
  Gene Symbol: GPSM3
  Gene Name: G-protein signaling modulator 3
  ENST ID: ENST00000487761
  CDS Start-End: 387-860

SEQ ID NO: 138604 - DNA, 1417 bp, Homo sapiens; identical to SEQ ID NO: 138593
  Payload ID: 7156
  Gene Symbol: GPSM3
  Gene Name: G-protein signaling modulator 3
  ENST ID: ENST00000472993
  CDS Start-End: 373-522

SEQ ID NO: 138605 - DNA, 1177 bp, Homo sapiens
  Payload ID: 7156
  Gene Symbol: GPSM3
  Gene Name: G-protein signaling modulator 3
  ENST ID: ENST00000619085
  CDS Start-End: 1-375
atgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgg

SEQ ID NO: 138606 - DNA, 1177 bp, Homo sapiens; identical to SEQ ID NO: 138605
  Payload ID: 7156
  Gene Symbol: GPSM3
  Gene Name: G-protein signaling modulator 3
  ENST ID: ENST00000619014
  CDS Start-End: 1-375

SEQ ID NO: 138607 - DNA, 1177 bp, Homo sapiens; identical to SEQ ID NO: 138605
  Payload ID: 7156
  Gene Symbol: GPSM3
  Gene Name: G-protein signaling modulator 3
  ENST ID: ENST00000622679
  CDS Start-End: 1-375

SEQ ID NO: 138608 - DNA, 1177 bp, Homo sapiens; identical to SEQ ID NO: 138605
  Payload ID: 7156
  Gene Symbol: GPSM3
  Gene Name: G-protein signaling modulator 3
  ENST ID: ENST00000614086
  CDS Start-End: 1-375

SEQ ID NO: 138609 - DNA, 1177 bp, Homo sapiens; identical to SEQ ID NO: 138605
  Payload ID: 7156
  Gene Symbol: GPSM3
  Gene Name: G-protein signaling modulator 3
  ENST ID: ENST00000615815
  CDS Start-End: 1-375

SEQ ID NO: 138610 - DNA, 1177 bp, Homo sapiens; identical to SEQ ID NO: 138605
  Payload ID: 7156
  Gene Symbol: GPSM3
  Gene Name: G-protein signaling modulator 3
  ENST ID: ENST00000616454
  CDS Start-End: 1-375

SEQ ID NO: 138611 - DNA, 3563 bp, Homo sapiens
  Payload ID: 7157
  Gene Symbol: GRHL1
  Gene Name: grainyhead-like transcription factor 1
  Uniprot ID: Q9NZI5
  ENST ID: ENST00000324907
  CDS Start-End: 137-1993
gagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctctctcccttaccctctcactctccaccagatgtttactaaacagggcatgttactgaaatcttcctttgcgactttctcggacatatcaactgcctttctcatgaagaattttaatgggttacagtatgaaatcagttaagataaagctgcattgtatataagtgcaatatatttttgaaggtctgtaaatgtgtacatacatgtcttatataaatatataatatataaatatggtgtctgtgtacatatagtgaagatatgcagtaagagctaccttaaagactttccctagacaaaggttaagttattttttgatcgtgtataccaagcagatagaatactgtgcttagtggaacccgctaaaaacctttttctctgtttttccaaacacaggcattctgtagcatagcaaaaccttctcaaatgacagagattctgtttgctgttgagaatgttgttatttggatttctgcactgtttaacaaatgaagtaaaagaaaaacactactgcaatcacgtcttttgttatgctagtatcagtcagatgcacttagagtgaagaaacactgtaattacagcacacagattgcaagtattgcgtaccaagtgatacaactcgaaatgcagttctcatcttcctgttttgagaaatgattattttatcacgcatcagagccttcgtgctttgattatcttgtatgttaacaattctagaaaacattcatgaattcacaaaaatatgttactatggcaggggaacattttgtacacatttaagtatataaaaatactaaaatatgtaattttataacaaagtcacgggtatctttaggttcagggaactagactaggtcattcgtgtaaatggactggtagttacagtcttaggttaaagtattctaatgaagtatgggaactaaattgctggttttctaagataagatatgggatatgggtcatataacttttgtattttttatgaagttgattttgtcttgcgtgttatttttaattgtatcattgaagatgtattttaaaccaaaggaattaaattttatatgtctatttcgtaa

SEQ ID NO: 138612 - DNA, 1881 bp, Homo sapiens
  Payload ID: 7157
  Gene Symbol: GRHL1
  Gene Name: grainyhead-like transcription factor 1
  Uniprot ID: Q9NZI5
  ENST ID: ENST00000405379
  CDS Start-End: 94-1383
ataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctct

SEQ ID NO: 138613 - DNA, 564 bp, Homo sapiens
  Payload ID: 7157
  Gene Symbol: GRHL1
  Gene Name: grainyhead-like transcription factor 1
  ENST ID: ENST00000439493
  CDS Start-End: 142-423
agagcgagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaaggtaacattcagtgcctaacagcataaagagtgcagggggaaatgccacgtttctgtaacagcaaaatgggagtttgtttaaatgaacaaccactagtgaaagagatagaaacagcataccaattgtgacagagcagcccctcatc

SEQ ID NO: 138614 - DNA, 2060 bp, Homo sapiens
  Payload ID: 7157
  Gene Symbol: GRHL1
  Gene Name: grainyhead-like transcription factor 1
  Uniprot ID: Q9NZI5
  ENST ID: ENST00000472167
  CDS Start-End: 53-1588
tgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaaggcaagtgtcctgaccccagctcccagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttc

SEQ ID NO: 138615 - DNA, 572 bp, Homo sapiens
  Payload ID: 7157
  Gene Symbol: GRHL1
  Gene Name: grainyhead-like transcription factor 1
  ENST ID: ENST00000480736
  CDS Start-End: 195-413
agacagccaggcgtggtggatcatgcctataattccagcactttgggaggccaagctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttg

SEQ ID NO: 138616 - DNA, 2099 bp, Homo sapiens
  Payload ID: 7157
  Gene Symbol: GRHL1
  Gene Name: grainyhead-like transcription factor 1
  ENST ID: ENST00000464418
  CDS Start-End: 287-976
agagcgagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaaaatatgcagttaaattattgcctgaaacatatttcagaagtctgagagatcgcagacgcggagtttaaggctcacctgaaagtgatgatgagccttcggcgactgaagcctacttcctgactgtcatgaggaagtggactaagaaaggcaactgcaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctcccca

SEQ ID NO: 138617 - DNA, 5239 bp, Homo sapiens
  Payload ID: 7158
  Gene Symbol: GRHL2
  Gene Name: grainyhead-like transcription factor 2
  Uniprot ID: Q6ISB3
  ENST ID: ENST00000251808
  CDS Start-End: 339-2216
tccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaagcggagcaagttcattggatcaaacatgtcacaagagtcggacaataataaaagactagtggccttagtgcccatgcccagtgaccctccattcaatacccgaagagcctacaccagtgaggatgaagcctggaagtcatacttggagaatcccctgacagcagccaccaaggccatgatgagcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagctgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctctctcacccctccatatctatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcttgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgcatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgcaaatgcaacagaaatagagggtttgtgccaaatgctatgaacggccctttcttaaagacaagcaagggagattgatatatgtacaatttgctctcatgttttaaaaaaaaaaaggtaaatgtaacttaatagttttgtaaatgggagagggggaatctataaactataaatacagttattttattttttgtacatttttaaggagaaaaaataaatattcataacataagagtaaaa

SEQ ID NO: 138618 - DNA, 2140 bp, Homo sapiens
  Payload ID: 7158
  Gene Symbol: GRHL2
  Gene Name: grainyhead-like transcription factor 2
  Uniprot ID: Q6ISB3
  ENST ID: ENST00000395927
  CDS Start-End: 121-1950
attggatcaaacatgtcacaagagtcggacaagtaagtggatcacacgcgccggctgctgctactactaccactttgggctgatggcaactgtaataaaagactagtggccttagtgcccatgcccagtgaccctccattcaatacccgaagagcctacaccagtgaggatgaagcctggaagtcatacttggagaatcccctgacagcagccaccaaggccatgatgagcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctac

SEQ ID NO: 138619 - DNA, 236 bp, Homo sapiens
  Payload ID: 7158
  Gene Symbol: GRHL2
  Gene Name: grainyhead-like transcription factor 2
  ENST ID: ENST00000521085
  CDS Start-End: 217-236
gagaaagttacctgtggccgcccaagtccgccactttctgctctgtgtctgcccattgccacgatccaggaggactccgcgccgcccggccgcctccgagctcgggccccatgtgaggggcccccccttatcccacctttccggctagacttgaaagtccagtttcaccagaggctgaggctccaggaaaagcggagcaagttcattggatcaaacatgtcacaagagtcggacaa

SEQ ID NO: 138620 - DNA, 1870 bp, Homo sapiens
  Payload ID: 7159
  Gene Symbol: GRHL3
  Gene Name: grainyhead-like transcription factor 3
  Uniprot ID: Q8TE85
  ENST ID: ENST00000236255
  CDS Start-End: 47-1870
aggagatgtgccaaactgttaagagtggttatttctgagcagaagaatgtggatgaattccattcttcctatttttcttttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaa

SEQ ID NO: 138621 - DNA, 2119 bp, Homo sapiens
  Payload ID: 7159
  Gene Symbol: GRHL3
  Gene Name: grainyhead-like transcription factor 3
  Uniprot ID: Q8TE85
  ENST ID: ENST00000350501
  CDS Start-End: 128-2008
ctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgatttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggggaaacttctctcctccacccacgcctgtctcgccaccccccacctgactgtcttgaatgttcccatcctgtgactcaagtgaggaacatgggttttggagatggattttggaggcagagggacctggattcaaatcccagccccaccaccgtcaacagcctgcacttcactgtaaactcggaatgacacacccacctggaggagaggtggaaggacgacggcaggtcacatctgagagctctcagctcagagtatgtggcccctgaatacattctggctattactttgcatttaaaa

SEQ ID NO: 138622 - DNA, 2804 bp, Homo sapiens
  Payload ID: 7159
  Gene Symbol: GRHL3
  Gene Name: grainyhead-like transcription factor 3
  Uniprot ID: Q8TE85
  ENST ID: ENST00000356046
  CDS Start-End: 304-1974
tgagtgagtaaacatcggtggatacctgccgctctcagagcgtggaggctggatggggtttcctggagggggaagagcggggaggccggcaccgggattcacagagcaatttgtaagggtaaatgaatgggctgacgatcttactttggcgtgtcaaggcaagccccagtctcaagctagagtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatta

SEQ ID NO: 138623 - DNA, 2869 bp, Homo sapiens
  Payload ID: 7159
  Gene Symbol: GRHL3
  Gene Name: grainyhead-like transcription factor 3
  Uniprot ID: Q8TE85
  ENST ID: ENST00000361548
  CDS Start-End: 231-2039
agagttaacagctgcacctgttgaggtatacctccagtcgccggcacctgtacctgtagccaatcagcgccagcgctgctgggaacctacctgtcagcaaaatctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgatttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatta

SEQ ID NO: 138624 - DNA, 494 bp, Homo sapiens
  Payload ID: 7159
  Gene Symbol: GRHL3
  Gene Name: grainyhead-like transcription factor 3
  ENST ID: ENST00000524724
  CDS Start-End: 250-494
gaaacacaagactgaaactgtgaaggtttctggcaccactttttgatcctctgaaggggccttggaaatcagacgaccccaatcccatcgaggctttctatcttcttgccaaaaggaacttctttaagtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaa

SEQ ID NO: 138625 - DNA, 1683 bp, Homo sapiens
  Payload ID: 7159
  Gene Symbol: GRHL3
  Gene Name: grainyhead-like transcription factor 3
  ENST ID: ENST00000528064
  CDS Start-End: 47-205
aggagatgtgccaaactgttaagagtggttatttctgagcagaagaatgtggatgaattccattcttcctatttttctggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaa

SEQ ID NO: 138626 - DNA, 2523 bp, Homo sapiens
  Payload ID: 7160
  Gene Symbol: GRAMD1A
  Gene Name: GRAM domain containing 1A
  Uniprot ID: Q96CP6
  ENST ID: ENST00000411896
  CDS Start-End: 54-2195
ctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 138627 - DNA, 2695 bp, Homo sapiens
  Payload ID: 7160
  Gene Symbol: GRAMD1A
  Gene Name: GRAM domain containing 1A
  Uniprot ID: Q96CP6
  ENST ID: ENST00000317991
  CDS Start-End: 193-2367
gtcgctgacgccgcggcggcctccggcggctccggccttttgtgcgggcggttgggtcgggtgggggcggcggccgcggaaggccaggccggtgccctgcggggacgcccagcgcagcccagccccgcgcagcccagccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtgatctgtgtgagccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 138628 - DNA, 2825 bp, Homo sapiens
  Payload ID: 7160
  Gene Symbol: GRAMD1A
  Gene Name: GRAM domain containing 1A
  ENST ID: ENST00000599564
  CDS Start-End: 72-2495
aagtctgaatgctgtgtggacagaggaggaggacccaataagagaccacaccgctgttccagaccctctccatggatgatgtcctgcccctgatgccttgggagaccctgttggcacagggcagtccccagggctcgcctgacctcccagcagggcagcggaagcagcagccacagggtgacagggcccagggcctggcctctgagtcctggaagctcctggaggtgcccatcattcacataacgccatccagtgatggggagtcccccgcctgcaccccaaccccccgacgccggcagcagcagaggatgccagacccgcagagtctgtcccaggacagcaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtggc

SEQ ID NO: 138629 - DNA, 2534 bp, Homo sapiens
  Payload ID: 7160
  Gene Symbol: GRAMD1A
  Gene Name: GRAM domain containing 1A
  ENST ID: ENST00000600231
  CDS Start-End: 157-825
cttttgtgcgggcggttgggtcgggtgggggcggcggccgcggaaggccaggccggtgccctgcggggacgcccagcgcagcccagccccgcgcagcccagccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 138630 - DNA, 808 bp, Homo sapiens
  Payload ID: 7160
  Gene Symbol: GRAMD1A
  Gene Name: GRAM domain containing 1A
  ENST ID: ENST00000424536
  CDS Start-End: 24-641
ggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaaggtgacggaggacccggtgacgggaccacgcggtcccccgctcagcaggccgcctcccccaaacatgcaaagccccatttgttctgcaccctgagttctctccgagctgtccccttctctctgttctcccggcccaggcgcccatcacccctgacctgatccccgcaccagcctctcctctctttccctgcaacctgttacctcacacagctgctcaggaacagcagaaatagtaaaactcttccatgtatgtggcacctc

SEQ ID NO: 138631 - DNA, 2571 bp, Homo sapiens
  Payload ID: 7161
  Gene Symbol: GRAMD1B
  Gene Name: GRAM domain containing 1B
  ENST ID: ENST00000322282
  CDS Start-End: 328-2544
cagccttgccagcattacccatcctcatcagaaactggcagcggcagccacagctcgggcaggcggctccagccccaggctggatttgcagaatctgtcctttgcctccaagcccagctttcagctgggagagggggaagaaggggcagtggcagcagttcttctggctctttctccctttctctctttctctttctgtgttcaagtcacattacatgggattctgttcttttgggacttcgtcatcttttccaatatgtcctgggacctccggagctgtaacggggatgctaaggacacggtcagtggattatcgtgactgtactaatgaaaggattcaagctctcctgcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgtggtctccttcagtctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaaga

SEQ ID NO: 138632 - DNA, 2431 bp, Homo sapiens
  Payload ID: 7161
  Gene Symbol: GRAMD1B
  Gene Name: GRAM domain containing 1B
  Uniprot ID: Q3KR37
  ENST ID: ENST00000450171
  CDS Start-End: 694-1971
ggtgccaagggttcgggggggagcactgaggctttagcagctctcctgtatcctcatttgcatcctcctgtagcagctggaaaattcagattacaggtgaaattccctggctggcaatcttctgtatatggacacagtgatgtgccagaagggctttgcatccctgagactgaaggaagctccatttttggagccctcccacaccttgctctgtgtgcctctcattctgatttgaattcttattttgctatatgatgaagctgtaatcctaagtttaaaaaggggagtaggtattgacatcatggtagaaataggctgtcttatggaactgtagttagggatcacagcctattggaccagccccagccttagcagcagttctgtacactgattcttccagattagtctacgttccctcgaacagacctatgccatgggttacaactacaatttgttgtcgattagagttaacttacagactctcaaaaccccattctttgggtttaggcaacttccagaagtagtcatttatttgaattttagtctaagatcaactgaattagggaggtttgaaagtgtaaaagcaaatcgtacattcccaaacactttgtaaagaaggaatgggtagtgtcagctaaaggaaatggtgtgcatcccagcaaaagaaagagaccgaaagcaaagtcataaaccatgcccacgagctcagctgtcctgctccgtgtcctctccatacccttgttgactgtgctcatattagccagagacctaagtgctcttggaggatgtccctggggccccctccccctccgctgtcactgtctacttcctgatcctctcttctgtgcaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgttctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcattccctaatccccttttgatttgtttccaaaataaaagagaatcttttcttcccta

SEQ ID NO: 138633 - DNA, 2805 bp, Homo sapiens
  Payload ID: 7161
  Gene Symbol: GRAMD1B
  Gene Name: GRAM domain containing 1B
  Uniprot ID: Q3KR37
  ENST ID: ENST00000456860
  CDS Start-End: 514-2751
agattatatggagctgcgggagctgccgcctgggggaagagaggtgcagcttctgctaggtttgtgctctcctcccagggtctccttggcttccttccccaaagcagctcagagctggtatgaggtgagggtggggggcagccggccagcctggctgttgacggcaactccagggcttgtttcgcgcagccttgccagcattacccatcctcatcagaaactggcagcggcagccacagctcgggcaggcggctccagccccaggctggatttgcagaatctgtcctttgcctccaagcccagctttcagctgggagagggggaagaaggggcagtggcagcagttcttctggctctttctccctttctctctttctctttctgtgttcaagtcacattacatgggattctgttcttttgggacttcgtcatcttttccaatatgtcctgggacctccggagctgtaacggggatgctaaggacacggtcagtggattatcgtgactgtactaatgaaaggattcaagctctcctgcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagtctcacaagcgcctctcaaaaaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgtgatctgtttcagtctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagacc

SEQ ID NO: 138634 - DNA, 6266 bp, Homo sapiens
  Payload ID: 7161
  Gene Symbol: GRAMD1B
  Gene Name: GRAM domain containing 1B
  Uniprot ID: Q3KR37
  ENST ID: ENST00000529432
  CDS Start-End: 364-2460
gagctcagaacagctgtctgtgagggagtcagagggagagagagaaagggagccaggcagagagagagagggacttctgtaaggcggcacgaccacaccaaataacagcagcagagggaggtgggggagagggaaataaaggggagtcatgcttaaaatgctacagcggtgtgaaacagcagagcaaagaagcgcccccagcttctgagagccctggcccgagtcccctcccccgttagaaacagggctttgggatggtcatggagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgtgatctgtttcagtctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcattccctaatccccttttgatttgtttccaaaataaaagagaatcttttcttccctaccccaggcttccccaggcattctcttgggaacacagaagcatcaagggagcccagtctaaactcctagggttggccgcccacttgatccagaccgtactgagtgtcagatggagaggatgcttggaaagctaggaaggctgcattgtgtggtggcaggctcccgagactcgtgttctgaaggatactctcctccatcacccctgcaccttcctccgacctgtgtagggtgtggacccagtaagggctgggaatttcttactttcccacccgctttctctctggtcttctcccaggctggatctgggcgaagtgtcactttttagtgcctaaagtcctattgtttctctgtgccctaagagcacattgtttattagccagggtggagcgttttcgaccttattaaacctcttttagtgcttctaagcaagtcaggtctgtggctctgaggccttcacttagagctgtcagtgtgatttccaggatgagtcagggtgtgctgggccctccaggatttgagagagggagagaaggcccttgccacgtccggggtgcagggtctacccacagaacactgtgagtggtgagcaccaagatgggttgccagcctcatttgctctttgaacgaaccaacattagccagtggagacgactgtctgagacagtttgcacatagaaaaagcatctgagccactggagggaaggatttggcaaaggtgcatgtgtttgggcaggaaaaggccaagtgaaatctatgccctacgggagccattcccaatcctgagtttctcagacttggcaatgggggttctggcgggggttggagtacaaatcctgctctggtctctggccccacagaggtgtaagatcattaagaagtagaaggcactagcttcaaagagtgagacattcagggccttttcagcattggcccactagcaccatgcatttatctgaattcacggggccctctgggcacattcatcatccctcatacactaactactgtttcttcatgtaatgaccaaaagagtcccaccagctccaggcagagcttgtggagattcatgaaagagtcatagccagtttggcatgcagaggtcttcagtcttgcttattcttctcctgggcttcttgacacaggggcagaagaaaccccagatgtcccagatgtcccagaacatcagcccaaaagacagaagattttatcactcatctaccccaaagataaagttgtatttttttcttagaatggcctttaattccctgtggcaattacagtttttgacttttccatgtgagaataaggccttggtatttccctaagggcaggatcagaaaacaggaaggtccatgcccaggtgatcctccaagggaggagggtgaggaggctccagggcatgagctagagtggatattcctcccctagaagaggagatgggaggaaatgcagtttcatgtaatccctgtgaagagtgcctatgcccacagcccagtgggtccttgttcagttcttgtccaggcctttgggtgagggacactggtagggatcaaggctcatgggctctgagccaaagaaggaggcatggtgcagactgctggaaatctcccccttggcacagccagaagccaaaactattcccagaaagttttgaatgcaaaacttgtagattcctgaatttattccatacataattatttccttaagttatttaattattaaaggtgccacggtgggacctttgggatgacttaaaaagggttctttgttgggagtcaagtgacagagcagacctggccgcagggagttgttctgcttctgctttacctctcaggaccattcccaggaggaaaaggtggcagagagggcagtactgagtatgtcagaagagccctcctggttttttagcgatttgaacccactagacaatgtgtgcacatagggaatgtcctttaagaatcatggatctcttgtaggctctctgtgttccaataattttttgactatcataccaggaaaaaaccaacaactctattcattcccaaacaaaatctcttcccccttagtcaatagcttgcgaaagacatcttaactcacccttgcagataagtcttggagtgaaacaaataaatagcattgtattcctggccatttgcctggctagttgctgtctacaagggagcatcaaaacatcactacttcttatgtaacttcttccagccagtgcttttattgttcgttttagtttactggggacacacaggagtctttctgtaatgacttatgtggtaaaatgtttgagagtttgcactcaattttaaagaatttgcagtttctaacaaggtgaagaacagctataggatctaaagttccattacagcttactgtgaaagaattgacaagactggcctcagacaagctaatcatggtgcgactctctcccttcctcatccacctctttggggacaagaggattacatctcaggccagcaagatcagctgcttgaagctctgtgtaagagcactgcactgacggtttggagacctgagcctgggtcctgacttttccattgactaagctctgtggccttgggcaagtcactccccctctctgagcttcagtatcctcctgtcacaggagggagttgggctagatcatctttaaggtaggttctagctttgacatcatcttgggggttaggccagaggctgggaagactgggtggactttctcaattgctctgccaggagggaacaagcccagaggctgaagcttcccagtatttagaggtgtggtagggcagtgtctgcattcccaggagacccagggtgattaaaatttattctttaggtggctaggagggctggggaggcccagtggaagagagagagagagagagagagagagagagagagagagagagagatcgagcttgatgtattgctcagtattcacttagaagggtttctttctctttggcctagtttgtgaagggatcttcctttggactttctctaagttgggagaagaacattcttttcaatggagctcatcttctatctctagggtctgttcagcctttcatctatccatccttcctctttattggtagaagaaacagtggagagtagccacttctggttctagcacttctcttttgttaagatagggtttggatttagtatgaagctttggctaaaacccttgggtttgccttagaacactgacactaagaacctggaatgacatggggaggacaaagagagctcaagaggaatgctttgtgagaagtggattctctccgtgtccctgccccccacccaaacttgaactatacctattacat

SEQ ID NO: 138635 - DNA, 1689 bp, Homo sapiens
  Payload ID: 7161
  Gene Symbol: GRAMD1B
  Gene Name: GRAM domain containing 1B
  ENST ID: ENST00000534764
  CDS Start-End: 366-1689
gtctgtgagggagtcagagggagagagagaaagggagccaggcagagagagagagggacttctgtaaggcggcacgaccacaccaaataacagcagcagagggaggtgggggagagggaaataaaggggagtcatgcttaaaatgctacagcggtgtgaaacagcagagcaaagaagcgcccccagcttctgagagccctggcccgagtcccctcccccgttagaaacagggctttgggatggtcatggaggtgagtgccctccagcctcctcagggcccccgctccccgcccccgccccccactgcccaatgcatgaatgaatgagttcctctctgcactgcactctgctactgttcctacctaatggcttccagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtca

SEQ ID NO: 138636 - DNA, 7723 bp, Homo sapiens
  Payload ID: 7161
  Gene Symbol: GRAMD1B
  Gene Name: GRAM domain containing 1B
  Uniprot ID: Q3KR37
  ENST ID: ENST00000529750
  CDS Start-End: 328-2544
cagccttgccagcattacccatcctcatcagaaactggcagcggcagccacagctcgggcaggcggctccagccccaggctggatttgcagaatctgtcctttgcctccaagcccagctttcagctgggagagggggaagaaggggcagtggcagcagttcttctggctctttctccctttctctctttctctttctgtgttcaagtcacattacatgggattctgttcttttgggacttcgtcatcttttccaatatgtcctgggacctccggagctgtaacggggatgctaaggacacggtcagtggattatcgtgactgtactaatgaaaggattcaagctctcctgcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctggagggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccatgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgtgatctgtttcagtctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcattccctaatccccttttgatttgtttccaaaataaaagagaatcttttcttccctaccccaggcttccccaggcattctcttgggaacacagaagcatcaagggagcccagtctaaactcctagggttggccgcccacttgatccagaccgtactgagtgtcagatggagaggatgcttggaaagctaggaaggctgcattgtgtggtggcaggctcccgagactcgtgttctgaaggatactctcctccatcacccctgcaccttcctccgacctgtgtagggtgtggacccagtaagggctgggaatttcttactttcccacccgctttctctctggtcttctcccaggctggatctgggcgaagtgtcactttttagtgcctaaagtcctattgtttctctgtgccctaagagcacattgtttattagccagggtggagcgttttcgaccttattaaacctcttttagtgcttctaagcaagtcaggtctgtggctctgaggccttcacttagagctgtcagtgtgatttccaggatgagtcagggtgtgctgggccctccaggatttgagagagggagagaaggcccttgccacgtccggggtgcagggtctacccacagaacactgtgagtggtgagcaccaagatgggttgccagcctcatttgctctttgaacgaaccaacattagccagtggagacgactgtctgagacagtttgcacatagaaaaagcatctgagccactggagggaaggatttggcaaaggtgcatgtgtttgggcaggaaaaggccaagtgaaatctatgccctacgggagccattcccaatcctgagtttctcagacttggcaatgggggttctggcgggggttggagtacaaatcctgctctggtctctggccccacagaggtgtaagatcattaagaagtagaaggcactagcttcaaagagtgagacattcagggccttttcagcattggcccactagcaccatgcatttatctgaattcacggggccctctgggcacattcatcatccctcatacactaactactgtttcttcatgtaatgaccaaaagagtcccaccagctccaggcagagcttgtggagattcatgaaagagtcatagccagtttggcatgcagaggtcttcagtcttgcttattcttctcctgggcttcttgacacaggggcagaagaaaccccagatgtcccagatgtcccagaacatcagcccaaaagacagaagattttatcactcatctaccccaaagataaagttgtatttttttcttagaatggcctttaattccctgtggcaattacagtttttgacttttccatgtgagaataaggccttggtatttccctaagggcaggatcagaaaacaggaaggtccatgcccaggtgatcctccaagggaggagggtgaggaggctccagggcatgagctagagtggatattcctcccctagaagaggagatgggaggaaatgcagtttcatgtaatccctgtgaagagtgcctatgcccacagcccagtgggtccttgttcagttcttgtccaggcctttgggtgagggacactggtagggatcaaggctcatgggctctgagccaaagaaggaggcatggtgcagactgctggaaatctcccccttggcacagccagaagccaaaactattcccagaaagttttgaatgcaaaacttgtagattcctgaatttattccatacataattatttccttaagttatttaattattaaaggtgccacggtgggacctttgggatgacttaaaaagggttctttgttgggagtcaagtgacagagcagacctggccgcagggagttgttctgcttctgctttacctctcaggaccattcccaggaggaaaaggtggcagagagggcagtactgagtatgtcagaagagccctcctggttttttagcgatttgaacccactagacaatgtgtgcacatagggaatgtcctttaagaatcatggatctcttgtaggctctctgtgttccaataattttttgactatcataccaggaaaaaaccaacaactctattcattcccaaacaaaatctcttcccccttagtcaatagcttgcgaaagacatcttaactcacccttgcagataagtcttggagtgaaacaaataaatagcattgtattcctggccatttgcctggctagttgctgtctacaagggagcatcaaaacatcactacttcttatgtaacttcttccagccagtgcttttattgttcgttttagtttactggggacacacaggagtctttctgtaatgacttatgtggtaaaatgtttgagagtttgcactcaattttaaagaatttgcagtttctaacaaggtgaagaacagctataggatctaaagttccattacagcttactgtgaaagaattgacaagactggcctcagacaagctaatcatggtgcgactctctcccttcctcatccacctctttggggacaagaggattacatctcaggccagcaagatcagctgcttgaagctctgtgtaagagcactgcactgacggtttggagacctgagcctgggtcctgacttttccattgactaagctctgtggccttgggcaagtcactccccctctctgagcttcagtatcctcctgtcacaggagggagttgggctagatcatctttaaggtaggttctagctttgacatcatcttgggggttaggccagaggctgggaagactgggtggactttctcaattgctctgccaggagggaacaagcccagaggctgaagcttcccagtatttagaggtgtggtagggcagtgtctgcattcccaggagacccagggtgattaaaatttattctttaggtggctaggagggctggggaggcccagtggaagagagagagagagagagagagagagagagagagagagagagagatcgagcttgatgtattgctcagtattcacttagaagggtttctttctctttggcctagtttgtgaagggatcttcctttggactttctctaagttgggagaagaacattcttttcaatggagctcatcttctatctctagggtctgttcagcctttcatctatccatccttcctctttattggtagaagaaacagtggagagtagccacttctggttctagcacttctcttttgttaagatagggtttggatttagtatgaagctttggctaaaacccttgggtttgccttagaacactgacactaagaacctggaatgacatggggaggacaaagagagctcaagaggaatgctttgtgagaagtggattctctccgtgtccctgccccccacccaaacttgaactatacctattacatttccaggcagtatccctaagatgagatcctggagaaaggactaggggaagtatctttctggatgcttgtggtcccagaagggtactttctgtgtcataccatgccacttctttaagctcttcagggcagccaaagccagcccttttctcctactgcccccaggagaaatagcactcttctcccttcccccagatggcagggctctggcctccctacacctcataccctgcctgcctcctccaggaggaatctccggggccccttcctgactctccccaccttcgccacttgtctctaggctatgggacaatcatcccattcaccacttgacatccttgacatccttgactttcattcccccaacctccagcaggttggccccaatcctcttcacctctgtgttttcttctagaagatgcattttgggtctgagaggagcattttcctggaaggccatcttttaaggcccctgcttgctgtcatagtgcagagcagaaacttgcacactatttagagagctcccttcccacctctctgcccagccttgttacctcacttctgctctggccatggctgtgaagggcccagccagctccctgttttgatgttctgtgcaacagctccggggtcttgtgactggagatcctcaacaggccctggagccaggactggagtcttggcagctgatgagcagcaccttgccggccaggaggagctgatgctgacgatctccccaacatctgaaggcttaaagaacattgtcgttcttcagccctccttgcttctctcaatacaataagacattgcagaagcaaaagggtggcctctgctccaggcaaggcagctggctctgtctggggcatcggcctggggcttgggtgccacgtgctgagattgcatagtcaaaacagccatttttgccaacaatagcttgtggctccccacattttcctaccctgcactcaagggccagaccactctctgcatggaccagaccatcttcccaaacccatggtgctttttccccaactcaacctagactccaaggtggggagggatgggtcagaggccatagtggcccctggataatcctgacgtggggtggagtggggtgaggcagagggagcagccccaacacctgcactgggccatctatgggaaagaacacgggtcgagtgcagtcgagttgtctggccatctgtatttggatctataactgtactttgcctggcgctgtgcgcaaggtcagaaaacttactgctagtacctagaaacacacaaggctgcccagccaaatcttaatgtaaagtagctagagccatggaagtacagtatgaattaaaaagaaaaaagtattgaactacaataataaa

SEQ ID NO: 138637 - DNA, 847 bp, Homo sapiens
  Payload ID: 7161
  Gene Symbol: GRAMD1B
  Gene Name: GRAM domain containing 1B
  ENST ID: ENST00000633646
  CDS Start-End: 348-847
gccaccaggctctgcggagggccctaagtgaatagagggcagcagtgtcttccaaatttgaaatgagtgacagtgggttataattaggggagaagatgctcttgatgctactgagaagatacagagtgagaacttttcttagaaaagtctgaggttgtaaagaagaaccaagcagccaacagagcagtcagcagagcagccacgatgatgattctagcaggttcctgagtcctcgagcgcgggaagaaagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaa

SEQ ID NO: 138638 - DNA, 577 bp, Homo sapiens
  Payload ID: 7161
  Gene Symbol: GRAMD1B
  Gene Name: GRAM domain containing 1B
  ENST ID: ENST00000633087
  CDS Start-End: 65-577
agttgaagtctaagtgacctcccccagggttgagaaagaagctgaagttaacggttgatatcctatgtctttcctcagcagccaacagagcagtcagcagagcagccacgatgatgattctagcaggttcctgagtcctcgagcgcgggaagaaagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctg

SEQ ID NO: 138639 - DNA, 541 bp, Homo sapiens
  Payload ID: 7161
  Gene Symbol: GRAMD1B
  Gene Name: GRAM domain containing 1B
  ENST ID: ENST00000632815
  CDS Start-End: 218-541
cggctgctctcatgtacctttagacagaggctgtgagtctctgggagtggagtgggggggtgtgaaccgcccgctcctggctcctgtgtaggcctcagtcagtctgaatgttattgcaagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctg

SEQ ID NO: 138640 - DNA, 4177 bp, Homo sapiens
  Payload ID: 7162
  Gene Symbol: GRAMD1C
  Gene Name: GRAM domain containing 1C
  Uniprot ID: Q8IYS0
  ENST ID: ENST00000358160
  CDS Start-End: 493-2481
aaaaattatccgggcgtggtggcaggcgcctgtaaccacagctactcgggaggctgaggcaggagaatcgcttgaactgggaggcggaggttgcagttagccgagacggggccttggcactccatccagcctgaggaatgagagcgaaactccgtctcaaaaaaaaaaaaaaaaagtttccgagcaattcaccttttcgcacattggggcagggtatgccatttcctgggaggcacagtagtttgaggttgggaatagggaagtctcattgtgacccctagaaagacaagccttcaggctaacccggtaacacccatcgtcaggaatccttcacggccgccagagggcgcaaggagctgcggctggaagtactcggagggccggcggaggaggcgcgcggagcctgtaactcgcagcgcgcgctggaggtgggcgcggggcggtgcggtgcggtgcgcgcggggcggtgccgcggcggcggagggagccgcgatggagggcgctccgactgtccgtcaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacaatttctattgctttaaagaatataaccttcatgaccaaggaaaaaactgctcgactcatcccaaacgctatccagatagttacagaaagtgaaaagtttttcttcacatcttttggtgccagggatagaagttacctcagtatctttaggttgtggcagaatgtattattagataagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctga

SEQ ID NO: 138641 - DNA, 3475 bp, Homo sapiens
  Payload ID: 7162
  Gene Symbol: GRAMD1C
  Gene Name: GRAM domain containing 1C
  Uniprot ID: Q8IYS0
  ENST ID: ENST00000440446
  CDS Start-End: 420-1793
tgtagagtgaggtataacttccaattctgcattctgacctgcaaccttggaaagagtgctggtactacaaccaggaagtgacagataatgtgctttaaactacattagaaaagcttctcatagcaaaactgagagattgaagcagtgattatttttacatagttgtcattaaatatttggagctctgctgtgcatagagatggcaacatacttagaatacacagctttctgggccagaaattgatcttctgacttttgagccttatctgattactgcttggttcatctttattttgttaaactactctgtaggctgaaagggagagactctccttggtttgcagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaa

SEQ ID NO: 138642 - DNA, 1162 bp, Homo sapiens
  Payload ID: 7162
  Gene Symbol: GRAMD1C
  Gene Name: GRAM domain containing 1C
  ENST ID: ENST00000472384
  CDS Start-End: 30-650
gcggtgccgcggcggcggagggagccgcgatggagggcgctccgactgtccgtcaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacatttttcttcacatcttttggtgccagggatagaagttacctcagtatctttaggttgtggcagaatgtattattagataagagcctgactagacaggaattctggcaactgctccagcagaactatggcactgagctaggtttaaatgctgaggagatggaaaacttgtcactgtcgattgaggatgtgcagccaaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacaga

SEQ ID NO: 138643 - DNA, 1576 bp, Homo sapiens
  Payload ID: 7162
  Gene Symbol: GRAMD1C
  Gene Name: GRAM domain containing 1C
  ENST ID: ENST00000462838
  CDS Start-End: 436-1576
attctagcaaggcaccagcgacatcgcagactatgcttggttatatactgtattgaatgtccttccaatgtcacatttgtgcttatcacacacatgtgagttgggatatgtccttataaaaacaaatatctccagggaagtgataaagttcaggtttacagatgagccaagggagaaactaagttcttcactttaatgaagaagaaagctctctgaagtgagaagaagaaagggaattccagaatactggaggccacccaccatagccaagaaacactgcatttactggctggaagtaaaatttacccttctttgaaaagatcctgatattatctgtgtttctgatgtatacacacggagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctg

SEQ ID NO: 138644 - DNA, 814 bp, Homo sapiens
  Payload ID: 7162
  Gene Symbol: GRAMD1C
  Gene Name: GRAM domain containing 1C
  ENST ID: ENST00000484714
  CDS Start-End: 6-275
ccgcgatggagggcgctccgactgtccgtcaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatag

SEQ ID NO: 138645 - DNA, 1876 bp, Homo sapiens
  Payload ID: 7162
  Gene Symbol: GRAMD1C
  Gene Name: GRAM domain containing 1C
  ENST ID: ENST00000472026
  CDS Start-End: 97-1584
aacttgttgagtgctcagaatccgtgaggtgcattctctcattctagcaaggcaccagcgacatcgcagactatgcttggttatatactgtattgaatgtccttccaatgtcacatttgtgcttatcacacacatagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccc

SEQ ID NO: 138646 - DNA, 567 bp, Homo sapiens
  Payload ID: 7162
  Gene Symbol: GRAMD1C
  Gene Name: GRAM domain containing 1C
  ENST ID: ENST00000488680
  CDS Start-End: 435-567
aattctgcattctgacctgcaaccttggaaagagtgctggtactacaaccaggaagtgacagataatgtgctttaaactacattagaaaagcttctcatagcaaaactgagagattgaagcagtgattatttttacatagttgtcattaaatatttggagctctgctgtgcatagagatggcaacatacttagaatacacagctttctgggccagaaattgatcttctgacttttgagccttatctgattactgcttggttcatctttattttgttaaactactctgtaggctgaaagggagagactctccttggtttgcagggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaatt

SEQ ID NO: 138647 - DNA, 3281 bp, Homo sapiens
  Payload ID: 7163
  Gene Symbol: GRAMD2
  Gene Name: GRAM domain containing 2
  Uniprot ID: Q8IUY3
  ENST ID: ENST00000309731
  CDS Start-End: 15-1079
gtgcaggcgccgggatgaccgctttaagccggagcgaggccaccgaggagggcggcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctcccagacaacatcccttgtatccctccatcatccgtggactccacagacagtttcttcccctccaggaagcctccaatgtctgaaaagtcaagagcccaagtagcttcagaaaatggtgggaggtgggcatggcccatgccaggctggggtcctgcctgccctaagaagatgccgaactgctctcccactgcaaagaatgctgtctatgaggaggatgagctggaggaggagcccaggagcactggggagctgaggctctgggattaccggctcctcaaggtcttctttgtgctgatctgcttcctggtcatgtcctcatcctacctggcgttccgtatttctcggctagagcagcagttatgctccttgagttgggatgacccagtccctgggcacaggtaacagccacttggcctttgtccccattccttctccaagaagaatgttctgggtgctaagtctccaccaatgatccctgtggtttatgctgctgctgtgctaagactgcctatgaaggaaaatattccagatccctcctcctccccgcagctcttctcttccctctatgagagatctgaagtacgtgtttacaaagtaactggcttctacaatttttggactcaagcaaaaagccagattttttggaaccaactgaggaattctgtacacaaagcttcagcaaacacttagagaaaacaaacaaacaaacaaactgggtccttggaaacagttctggcacacaggcagaacactggaggccacctcaaaggacagaggccatgctttcgcatttggaatgtggctctgccacacagctcactcctatggtggggtcagaggtcagaacacaaaccacccatgtgggctctgctccctcccaacactctgtgttcccacagggcttctctgcgggcagccaggcacctgtcaggcttgggcaggggcctgctgagaatctgtgaatgcagaggggagggctcatggccaggattccagccagagatgaatttccatgctctgggccagggctctgtgccggcccctcatgaggtggctggctgcattatggggagatgctgcccacggcggagatggtggcagtggctgtgaagaacagaggtacctgaattctgtgtcctcagctgtcactttccggtgagacaagtggagcagggcctttgatcactgtggtcacagacctggtactgggttttgcccttgtgtgctcaaacatttctaaggtgtcccaagccctggaaatagggaagggaagggtggaggcttggatctgaggtcttgctgtccactccctgcctgcctgcccgcatctcaggcatggccaacagcagcccgttgaggggggcttgtctggacagttgcgtgtgatggtgttgagccatcacagggcagaggtcacttgtgtcacccccatagtcattgggttgcaggccatggaggagggacctccactccatggggcctattctccattaaggtggaagtgtccactgtgggcctagcacagtgcaggaaccaggccagggggtctatctcatacctctggggacaggaaaggtagaggatgaggaggttggacgtggtggtggctttgccttggatattcctcttcctctatcaaggccttctcttcttctctgtgtcccacaactctggcctcatcgccctgggactcccatctgctaagatagtggctttggaggttctggaagggcttagtgaggaggccagaagtatcagggaaagttgctggtgatggggtgggcggtgtcagaagcagccactgttttcccctcttcagacactgagagattaatcagggaatgaaatccaggtggaaattatttattgtgaagcagacgactgtctgtcctgtttatgacaaacccaaatgagaattggagggactaccagtaagtggtctcttcatgctctccccatcccagtttttaggatgaaatttagagcctggccttttgtgttgcttgcaccaaatctgtatgtctcaggtgaaactcactgttccatgaatggtcatcctttttttttttttttttttggaaccagcccctttcaccctttcatccgtcttttttttttaggaaaataacccttcttgcttcagcacttctccctggtccttgctgaaagacagagataaaaatccattctctgagccttgcttggttgtcagaggccatgagaggtgccagttataggtggatgtgccaagatgctggtgaacttggtcttcagctatacccaggctcagaaagggcaagagccatgctgcagcgtaggtgactttggaggtgcacttggggcccagggctttgagtgttgcgggtgtgcctgtccctccagatagtgctctgtttctctctgttgtccccctgcctggtcctctggggccactgtgctttctgctgtgtgcatttataaatgatgtgtattttatatagacctgcttgcattggctgatgctcctctaattccctgagtttgattcaaccacccttgggttgttttgctatggccttagcctttgaaaatattttaaaataaaaaacttgatttttctagtgt

SEQ ID NO: 138648 - DNA, 556 bp, Homo sapiens
  Payload ID: 7163
  Gene Symbol: GRAMD2
  Gene Name: GRAM domain containing 2
  ENST ID: ENST00000570275
  CDS Start-End: 122-556
actttggacacttttgttctcggcataagcgagtctcagggtcctccctctcagtgtgcctcctcaagggtggggctagaggcctcactcagcctggcctacgagctgcctggcactggagatgagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaag

SEQ ID NO: 138649 - DNA, 507 bp, Homo sapiens
  Payload ID: 7163
  Gene Symbol: GRAMD2
  Gene Name: GRAM domain containing 2
  ENST ID: ENST00000562288
  CDS Start-End: 98-241
ataagcgagtctcagggtcctccctctcagtgtgcctcctcaagggtggggctagaggcctcactcagcctggcctacgagctgcctggcactggagatgagcaaccaacaaatgcacagaaagacagcttctctgaacagtcctgtgtcctgcaaagagaaaccagacagagttgaggagcccccggactacagtgccatccccctctcccagtgtggtagcctcagccaggtcaggtgagtctgtgccaagctccccgcagcagagctcaggccacaggaaggaggcggcagggagggcagtcctgctggcatcatggcctgtggccaggccccggcgcttctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcct

SEQ ID NO: 138650 - DNA, 623 bp, Homo sapiens
  Payload ID: 7163
  Gene Symbol: GRAMD2
  Gene Name: GRAM domain containing 2
  ENST ID: ENST00000568594
  CDS Start-End: 116-623
attttcagtgtcaccctcaatatcagggccagtcttgggtgggggccagaggcagcggccatgggcatggtggggctgttagggaaaggtgtcctcatgaagcccccttcctgatatgggcctgtttttccctagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtct

SEQ ID NO: 138651 - DNA, 664 bp, Homo sapiens
  Payload ID: 7163
  Gene Symbol: GRAMD2
  Gene Name: GRAM domain containing 2
  ENST ID: ENST00000564129
  CDS Start-End: 32-664
ctactttcccggaacctgatggtttacagtcatgctgcgcggcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctc

SEQ ID NO: 138652 - DNA, 3175 bp, Homo sapiens
  Payload ID: 7164
  Gene Symbol: GRAMD3
  Gene Name: GRAM domain containing 3
  Uniprot ID: Q96HH9
  ENST ID: ENST00000285689
  CDS Start-End: 462-1760
atctagagccggctgccctctaaaaatccccctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaagaaaaaa

SEQ ID NO: 138653 - DNA, 1847 bp, Homo sapiens
  Payload ID: 7164
  Gene Symbol: GRAMD3
  Gene Name: GRAM domain containing 3
  ENST ID: ENST00000513978
  CDS Start-End: 136-399
atgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagagtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttaca

SEQ ID NO: 138654 - DNA, 1532 bp, Homo sapiens
  Payload ID: 7164
  Gene Symbol: GRAMD3
  Gene Name: GRAM domain containing 3
  ENST ID: ENST00000514099
  CDS Start-End: 136-399
atgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgagg

SEQ ID NO: 138655 - DNA, 994 bp, Homo sapiens
  Payload ID: 7164
  Gene Symbol: GRAMD3
  Gene Name: GRAM domain containing 3
  ENST ID: ENST00000506445
  CDS Start-End: 131-994
acatgaagaaagagcttcctgcaattcaaggactgtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagctcggtgttcctcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaa

SEQ ID NO: 138656 - DNA, 1577 bp, Homo sapiens
  Payload ID: 7164
  Gene Symbol: GRAMD3
  Gene Name: GRAM domain containing 3
  Uniprot ID: Q96HH9
  ENST ID: ENST00000511134
  CDS Start-End: 81-1331
agagctgggcagcacagacctgggagccagcaagtccacacagtctggcatttacaagtgaaacagctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagaccc

SEQ ID NO: 138657 - DNA, 2196 bp, Homo sapiens
  Payload ID: 7164
  Gene Symbol: GRAMD3
  Gene Name: GRAM domain containing 3
  Uniprot ID: Q96HH9
  ENST ID: ENST00000513040
  CDS Start-End: 201-1544
tctcacacatgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccggacctggaactctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgta

SEQ ID NO: 138658 - DNA, 3109 bp, Homo sapiens
  Payload ID: 7164
  Gene Symbol: GRAMD3
  Gene Name: GRAM domain containing 3
  ENST ID: ENST00000515200
  CDS Start-End: 462-1694
atctagagccggctgccctctaaaaatccccctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagatacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagtagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaagaaaaaa

SEQ ID NO: 138659 - DNA, 1363 bp, Homo sapiens
  Payload ID: 7164
  Gene Symbol: GRAMD3
  Gene Name: GRAM domain containing 3
  ENST ID: ENST00000502348
  CDS Start-End: 343-1314
attccatttcccctcccacgctgctcactcaaacacacgctagcctctgctgcttgaattctacatagtttcagtctgctgctgacaagacctccaagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaag

SEQ ID NO: 138660 - DNA, 2977 bp, Homo sapiens
  Payload ID: 7164
  Gene Symbol: GRAMD3
  Gene Name: GRAM domain containing 3
  Uniprot ID: Q96HH9
  ENST ID: ENST00000542322
  CDS Start-End: 450-1772
ctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagagtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 138661 - DNA, 2822 bp, Homo sapiens
  Payload ID: 7164
  Gene Symbol: GRAMD3
  Gene Name: GRAM domain containing 3
  Uniprot ID: Q96HH9
  ENST ID: ENST00000544396
  CDS Start-End: 631-1617
ctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 138662 - DNA, 4315 bp, Homo sapiens
  Payload ID: 7165
  Gene Symbol: GRAMD4
  Gene Name: GRAM domain containing 4
  Uniprot ID: Q6IC98
  ENST ID: ENST00000361034
  CDS Start-End: 40-1776
cgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaggctc

SEQ ID NO: 138663 - DNA, 4484 bp, Homo sapiens
  Payload ID: 7165
  Gene Symbol: GRAMD4
  Gene Name: GRAM domain containing 4
  Uniprot ID: Q6IC98
  ENST ID: ENST00000406902
  CDS Start-End: 214-1950
ctccaggctccagggcagcagacaccaccctctccgtgcctgctggtgttgggcggcttggaggctatggttcctgggtcctcgtagcacatcctggttctgggccaggacctgaaggagccacagtgaaagagtgtttctggatgtatctgagacagacggagggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 138664 - DNA, 2834 bp, Homo sapiens
  Payload ID: 7165
  Gene Symbol: GRAMD4
  Gene Name: GRAM domain containing 4
  Uniprot ID: Q6IC98
  ENST ID: ENST00000408031
  CDS Start-End: 97-402
gctgggtacttccagtggaaagtgtgacaggcgggccttctcccattagtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaa

SEQ ID NO: 138665 - DNA, 669 bp, Homo sapiens
  Payload ID: 7165
  Gene Symbol: GRAMD4
  Gene Name: GRAM domain containing 4
  ENST ID: ENST00000456069
  CDS Start-End: 1-669
ggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtggtgctgacaagggacctcagcttagaggggcagaggctgcctgctccaagcaaggatggccccagctgggacttgggctctcttgagctgagctgtccctcctgggtcggccaccacgt

SEQ ID NO: 138666 - DNA, 311 bp, Homo sapiens
  Payload ID: 7165
  Gene Symbol: GRAMD4
  Gene Name: GRAM domain containing 4
  ENST ID: ENST00000431155
  CDS Start-End: 212-311
ccgccgcctccgcgctcgtggccgggacccgcggggccgcctcctcccggctccccggcgccgctgggctcccgggcgggcggcaggcgtagcgcggccgggcggccggcgaggggggcgccgcggcgggtggatgagagttggccccgatatccgctcaggggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcg

SEQ ID NO: 138667 - DNA, 375 bp, Homo sapiens
  Payload ID: 7165
  Gene Symbol: GRAMD4
  Gene Name: GRAM domain containing 4
  ENST ID: ENST00000447351
  CDS Start-End: 117-375
ggggagggcggatccaggtctggagtctttggattgaaaggttggagatgcctgtgggactcccaagggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattg

SEQ ID NO: 138668 - DNA, 1694 bp, Homo sapiens
  Payload ID: 7166
  Gene Symbol: GCA
  Gene Name: grancalcin, EF-hand calcium binding protein
  ENST ID: ENST00000233612
  CDS Start-End: 219-815
tgccaacgtgcgggtccgcccttggctcctgctccctgcgtccgcgcctggtactcggcggcgccggattccggggctgttgggggccagggcctgggcgagcattgatcctgggctgacttggagccgcaggttttctggtcgttgaggaccctcgaggagcgtcctggtggagccgagggagtaattttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactctaa

SEQ ID NO: 138669 - DNA, 691 bp, Homo sapiens
  Payload ID: 7166
  Gene Symbol: GCA
  Gene Name: grancalcin, EF-hand calcium binding protein
  ENST ID: ENST00000446271
  CDS Start-End: 252-691
ctcctccggcggatattttgttttcccagcaggttctgccttaacaataaggtcctttgtaggccaaaatgtgcagggcataaaagcatgtgatttgggactttccaaaggggaagtgaacagaaactgccacagacccggacgtgaacagggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctgtgggttcccaaacactaacttgtttccctgggaatttggaggtgggttcgaaaaatttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctct

SEQ ID NO: 138670 - DNA, 1992 bp, Homo sapiens
  Payload ID: 7166
  Gene Symbol: GCA
  Gene Name: grancalcin, EF-hand calcium binding protein
  Uniprot ID: P28676
  ENST ID: ENST00000437150
  CDS Start-End: 162-815
ggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactctaattgttcagaaattttacatttgacttatttgacaacattaacattagtggtggctttgccattaaaaacccagtaagtattttgagtgcatctatgtgatgtggtgttttgagcatagtaggcaccacagcaacttttctgcgtggtactaaaactgccgaaaatgcgacgtagaatcaccagatctttagtgtttaatatccctggtataagatgttataattaatgtaatttctttcttggcaaacacctcatgtctgtcttagtgaagatttaataaaccacttatttttcttat

SEQ ID NO: 138671 - DNA, 652 bp, Homo sapiens
  Payload ID: 7166
  Gene Symbol: GCA
  Gene Name: grancalcin, EF-hand calcium binding protein
  ENST ID: ENST00000453113
  CDS Start-End: 256-652
gcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggaagctgactgccaagctatgaaaaagtggaagagccatgtgaaagggcccatgtggaggagaactggggcccctggccaacaagtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgg

SEQ ID NO: 138672 - DNA, 655 bp, Homo sapiens
  Payload ID: 7166
  Gene Symbol: GCA
  Gene Name: grancalcin, EF-hand calcium binding protein
  ENST ID: ENST00000414723
  CDS Start-End: 1-440
ccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattgtggaggaatgaacgtaattaactttgaacatcttgatacagaaagacctgaatctgtgtgcaaaagtgactaagttccctttatccccctggaattcccatgagttgaggatcatctgaatttgagttgcatccatgaacagttttatcccttggtttcttatttgcgtggaaggcattttcataacgaagtactggtttagtaaaagcagtaaataggagtctccatgcaagagaaattggagtttcctaacatgcatgtgatttaaaaaataaaaataaaaaataa

SEQ ID NO: 138673 - DNA, 824 bp, Homo sapiens
  Payload ID: 7166
  Gene Symbol: GCA
  Gene Name: grancalcin, EF-hand calcium binding protein
  ENST ID: ENST00000429691
  CDS Start-End: 223-486
gggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctgtgggttcccaaacactaacttgtttccctgggaatttggagtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaa

SEQ ID NO: 138674 - DNA, 2342 bp, Homo sapiens
  Payload ID: 7167
  Gene Symbol: GRN
  Gene Name: granulin
  Uniprot ID: P28799
  ENST ID: ENST00000053867
  CDS Start-End: 257-2038
attctccaatcacatgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttc

SEQ ID NO: 138675 - DNA, 546 bp, Homo sapiens
  Payload ID: 7167
  Gene Symbol: GRN
  Gene Name: granulin
  ENST ID: ENST00000588143
  CDS Start-End: 57-546
agtctgagcgctacccggttgctgctgcccaaggaccgcggagtcggacgcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcact

SEQ ID NO: 138676 - DNA, 526 bp, Homo sapiens
  Payload ID: 7167
  Gene Symbol: GRN
  Gene Name: granulin
  ENST ID: ENST00000587518
  CDS Start-End: 118-526
atcgcgctggggtctgtagtctgagcgctacccggttgctgctgcccaaggaccgcggagtcggacgcagcagggaccacaccattcttgacccagctccacccctgtcggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttct

SEQ ID NO: 138677 - DNA, 1557 bp, Homo sapiens
  Payload ID: 7167
  Gene Symbol: GRN
  Gene Name: granulin
  ENST ID: ENST00000586443
  CDS Start-End: 1-1166
tggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccct

SEQ ID NO: 138678 - DNA, 535 bp, Homo sapiens
  Payload ID: 7167
  Gene Symbol: GRN
  Gene Name: granulin
  ENST ID: ENST00000587109
  CDS Start-End: 349-535
atcgcgctggggtctgtagtctgagcgctacccggttgctgctgcccaaggaccgcggagtcggacgcaggtaggagagcggccgcgcagacctctcgcctgctcctgcccaggggcccgccagggccatgtgagcttgaggttcccctggagtctcagccggagacaacagaagaaccgcttactgaaactccttgggggttctgatacactagggggagttttatgggaaagaggaagcagtaattgcagtgacgccccgttagaaggggctttctacctccccagcattcccccaaagcagggaccacaccattcttgacccagctccacccctgtcggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccagg

SEQ ID NO: 138679 - DNA, 763 bp, Homo sapiens
  Payload ID: 7167
  Gene Symbol: GRN
  Gene Name: granulin
  ENST ID: ENST00000593167
  CDS Start-End: 317-763
ggttgctgctgcccaaggaccgcggagtcggacgcaggtgctggcttcttcccctctcctggtggtggtgggtggttcccgcggcggcctggagccggaggggcgcgcgaccctgggctgggagctccgagggcctgggaacgagacctgagaccttggcttctcgaagggtaaacaggaggggccacatgcacaggtaattcaccagggagccgaacactcctgtgcagacagactccccttcccagcaagccatggcagcggacagcctgctgagaacacccaggaagcaggcggtgccagctgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgc

SEQ ID NO: 138680 - DNA, 558 bp, Homo sapiens
  Payload ID: 7167
  Gene Symbol: GRN
  Gene Name: granulin
  ENST ID: ENST00000588237
  CDS Start-End: 41-558
gctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctg

SEQ ID NO: 138681 - DNA, 546 bp, Homo sapiens
  Payload ID: 7167
  Gene Symbol: GRN
  Gene Name: granulin
  ENST ID: ENST00000589536
  CDS Start-End: 213-546
gtcatcgcgctggggtctgtagtctgagcgctacccggttgctgctgcccaaggaccgcggagtcggacgcaggtgctggcttcttcccctctcctggtggtggtgggtggttcccgcggcggcctggagccggaggggcgcgcgaccctgggctgggagctccgagggcctgggaacgagacctgagaccttggcttctcgaaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcct

SEQ ID NO: 138682 - DNA, 585 bp, Homo sapiens
  Payload ID: 7167
  Gene Symbol: GRN
  Gene Name: granulin
  ENST ID: ENST00000591740
  CDS Start-End: 181-585
gctgctgcccaaggaccgcggagtcggacgcagggtaaacaggaggggccacatgcacaggtaattcaccagggagccgaacactcctgtgcagacagactccccttcccagcaagccatggcagcggacagcctgctgagaacacccaggaagcaggcggtgccagctgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggac

SEQ ID NO: 138683 - DNA, 614 bp, Homo sapiens
  Payload ID: 7167
  Gene Symbol: GRN
  Gene Name: granulin
  ENST ID: ENST00000587387
  CDS Start-End: 41-614
gctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagagataaaagggccctgccaatgcaggtttctctgtgttccacaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgct

SEQ ID NO: 138684 - DNA, 1632 bp, Homo sapiens
  Payload ID: 7167
  Gene Symbol: GRN
  Gene Name: granulin
  ENST ID: ENST00000589265
  CDS Start-End: 38-1348
gctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttc

SEQ ID NO: 138685 - DNA, 562 bp, Homo sapiens
  Payload ID: 7167
  Gene Symbol: GRN
  Gene Name: granulin
  ENST ID: ENST00000585512
  CDS Start-End: 452-562
gctgctgcccaaggaccgcggagtcggacgcaggtaggagagcggccgcgcagacctctcgcctgctcctgcccaggggcccgccagggccatgtgagcttgaggttcccctggagtctcagccggagacaacagaagaaccgcttactgaaactccttgggggttctgatacactagggggagttttatgggaaagaggaagcagtaattgcagtgacgccccgttagaaggggctttctacctccccagcattcccccaaagcagggaccacaccattcttgacccagctccacccctgtcgggtaaacaggaggggccacatgcacaggtaattcaccagggagccgaacactcctgtgcagacagactccccttcccagcaagccatggcagcggacagcctgctgagaacacccaggaagcaggcggtgccagctgcaggcagaccatgtggaccctggtgagctgggtggccttaacagcagggctggtggctggaacgcggtgcccagatggtcagttctgccctgtggcctgctgcctggaccccggaggagcc

SEQ ID NO: 138686 - DNA, 665 bp, Homo sapiens
  Payload ID: 7167
  Gene Symbol: GRN
  Gene Name: granulin
  ENST ID: ENST00000586242
  CDS Start-End: 1-332
gctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttc

SEQ ID NO: 138687 - DNA, 541 bp, Homo sapiens
  Payload ID: 7167
  Gene Symbol: GRN
  Gene Name: granulin
  ENST ID: ENST00000592783
  CDS Start-End: 116-541
gctgctgcccaaggaccgcggagtcggacgcagaaggggctttctacctccccagcattcccccaaagcagggaccacaccattcttgacccagctccacccctgtcggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatg

SEQ ID NO: 138688 - DNA, 843 bp, Homo sapiens
  Payload ID: 7167
  Gene Symbol: GRN
  Gene Name: granulin
  ENST ID: ENST00000586782
  CDS Start-End: 29-598
ggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacag

SEQ ID NO: 138689 - DNA, 846 bp, Homo sapiens
  Payload ID: 7168
  Gene Symbol: GNLY
  Gene Name: granulysin
  Uniprot ID: P22749
  ENST ID: ENST00000263863
  CDS Start-End: 129-566
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagattttagccgcagctgcttcttctttggtggatttgaggggtgggtgtcagtggcatgctggggtgagctgtgtagtccttcaataaatgtctgtcgtgtgtcccata

SEQ ID NO: 138690 - DNA, 858 bp, Homo sapiens
  Payload ID: 7168
  Gene Symbol: GNLY
  Gene Name: granulysin
  Uniprot ID: P22749
  ENST ID: ENST00000409696
  CDS Start-End: 283-675
cctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttctgtgttcaaggcagacttcctgccccctgcaccctgctctctcccaggccttgaggtcagtgtgagccccaagggcaagaacacttctggaagggagagtggatttggctgggccatctggatggaaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagattttagccgc

SEQ ID NO: 138691 - DNA, 561 bp, Homo sapiens
  Payload ID: 7168
  Gene Symbol: GNLY
  Gene Name: granulysin
  ENST ID: ENST00000526018
  CDS Start-End: 1-561
cccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggccccacaacctgctcaggctgccgactggcttccaggatgtgcctctgggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaaga

SEQ ID NO: 138692 - DNA, 750 bp, Homo sapiens
  Payload ID: 7168
  Gene Symbol: GNLY
  Gene Name: granulysin
  ENST ID: ENST00000524600
  CDS Start-End: 62-580
aagctgcaggctccctgcccataaaacagggtgtgaaaggcatctcagcggctgccccaccatggctacctgggccctcctgctccttgcagccatgctcctgggcaacccaggccttgaggtcagtgtgagccccaagggcaagaacacttctggaagggagagtggatttggctgggccatctggatggaaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagca

SEQ ID NO: 138693 - DNA, 894 bp, Homo sapiens
  Payload ID: 7169
  Gene Symbol: GZMA
  Gene Name: granzyme A (granzyme 1, cytotoxic T-lymphocyte-associated serine esterase 3)
  Uniprot ID: P12544
  ENST ID: ENST00000274306
  CDS Start-End: 36-824
attttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgatggaaaaagcaaaaattaacaaatatgtgactatccttcatctacctaaaaagggggacgatgtgaaaccaggaaccatgtgccaagttgcagggtggggcaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgta

SEQ ID NO: 138694 - DNA, 968 bp, Homo sapiens
  Payload ID: 7170
  Gene Symbol: GZMB
  Gene Name: granzyme B (granzyme 2, cytotoxic T-lymphocyte-associated serine esterase 1)
  Uniprot ID: P10144
  ENST ID: ENST00000216341
  CDS Start-End: 108-851
ggaacatgaagtcactgagcctgctccacctctttcctctcccaagagctaaaagagagcaaggaggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaaa

SEQ ID NO: 138695 - DNA, 816 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000382540
  CDS Start-End: 108-716
ggaacatgaagtcactgagcctgctccacctctttcctctcccaagagctaaaagagagcaaggaggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagactggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacct

SEQ ID NO: 138696 - DNA, 666 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000382542
  CDS Start-End: 1-609
atgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaaggctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtc

SEQ ID NO: 138697 - DNA, 923 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000415355
  CDS Start-End: 99-806
gcaaggaggaaacaacagcagctccaaccagggcagccttcctgagaagatgcaaccaatcctgcttctgctggccttcctcctgctgcccagggcagatgcagacttttccttcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaaa

SEQ ID NO: 138698 - DNA, 517 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000532263
  CDS Start-End: 1-108
atgcaaccaatcctgcttctgctggccttcctcctgctgcccagggcagatgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtc

SEQ ID NO: 138699 - DNA, 819 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000526004
  CDS Start-End: 37-309
aacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaaggtaagactatgcacctgcctggattggctcttgggagaaagatgtttggggaatatctgagacctggagactcaagtagtgggggactccttcacccactagactgtgatatttctctctggaaagagaagaggggactagactgagctggggagaaattagggcctctgcaaacttaccaggaggcttatggtggatggtgcttctttggaaggatgaatttgcaacactccacccactccaggtcacagatattaggaaactgtgcccactgggggtgcagtaattataaccaggtgtgtcttcagaggctggtacc

SEQ ID NO: 138700 - DNA, 772 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000530830
  CDS Start-End: 64-198
gccttcctgagaagatgcaaccaatcctgcttctgctggccttcctcctgctgcccagggcagatgcaggaatgttctgaactccagctcccattctaccaagaccccccaagtgtgatgctggataagctatcagcaggaatggcagagcagcaggccattctcaagaagagccagggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtc

SEQ ID NO: 138701 - DNA, 665 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000554242
  CDS Start-End: 1-273
atgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtc

SEQ ID NO: 138702 - DNA, 559 bp, Homo sapiens
  Payload ID: 7170
  Gene Symbol: GZMB
  Gene Name: granzyme B (granzyme 2, cytotoxic T-lymphocyte-associated serine esterase 1)
  ENST ID: ENST00000616551
  CDS Start-End: 1-459
atgcaaccaatcctgcttctgctggccttcctcctgctgcccagggcagatcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacct

SEQ ID NO: 138703 - DNA, 909 bp, Homo sapiens
  Payload ID: 7171
  Gene Symbol: GZMH
  Gene Name: granzyme H (cathepsin G-like 2, protein h-CCPX)
  Uniprot ID: P20718
  ENST ID: ENST00000216338
  CDS Start-End: 46-786
ggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaatatga

SEQ ID NO: 138704 - DNA, 687 bp, Homo sapiens
  Payload ID: 7171
  Gene Symbol: GZMH
  Gene Name: granzyme H (cathepsin G-like 2, protein h-CCPX)
  Uniprot ID: P20718
  ENST ID: ENST00000382548
  CDS Start-End: 87-569
cccatccctccttcatctccctccagcatttgtttctggaaggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaa

SEQ ID NO: 138705 - DNA, 520 bp, Homo sapiens
  Payload ID: 7171
  Gene Symbol: GZMH
  Gene Name: granzyme H (cathepsin G-like 2, protein h-CCPX)
  ENST ID: ENST00000557220
  CDS Start-End: 55-402
tttctggaaggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaaggggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaa

SEQ ID NO: 138706 - DNA, 1509 bp, Homo sapiens
  Payload ID: 7172
  Gene Symbol: GZMK
  Gene Name: granzyme K (granzyme 3
  tryptase II)
  Uniprot ID: P49863
  ENST ID: ENST00000231009
  CDS Start-End: 71-865
ttcagaatcttcttccttcatcacaggatcaacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactctctgtttgtcttttatcacatgaagtaatatctgcccccattgcacccacactcgccaaagggcaataaggtcactgaataaaacagtaatggtaccaccttcaactaggtgtaacttctgctggatcatcctaagttgttgggttgttttcttttcattgttgtgataacattgaacatgagataggcccttgcaacaaatgtttaagggtatgatacattattgttaactataggcatgatcttgcagtgcagatctctagaactgcttcatctcatataaatgaaactttatgccagttgaatagcagctctctatttccccaccacccccatcctctggcaaccccattctactctaagcttctatgagtttgtattttttaaatataaatcataaatataaatatcctaattcaagcaagcagcttatacaaa

SEQ ID NO: 138707 - DNA, 940 bp, Homo sapiens
  Payload ID: 7173
  Gene Symbol: GZMM
  Gene Name: granzyme M (lymphocyte met-ase 1)
  Uniprot ID: P51124
  ENST ID: ENST00000264553
  CDS Start-End: 38-811
gccggggccagcacccacactgggtctccacagcggcatggaggcctgcgtgtcttcactgctggtgctggccctgggggccctgtcagtaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggcccagctgaggctggtgctggggctccacaccctggacagccccggtctcaccttccacatcaaggcagccatccagcaccctcgctacaagcccgtccctgccctggagaacgacctcgcgctgcttcagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaagggtgactcgggcgggcccctggtgtgtggcaaaggccgggtgttggccagagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctca

SEQ ID NO: 138708 - DNA, 941 bp, Homo sapiens
  Payload ID: 7173
  Gene Symbol: GZMM
  Gene Name: granzyme M (lymphocyte met-ase 1)
  ENST ID: ENST00000592501
  CDS Start-End: 152-808
ggccggggccagcacccacactgggtctccacagcggcatggaggcctgcgtgtcttcactgctggtgctggccctgggggccctgtcagtagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggcccagctgaggctggtgctggggctccacaccctggacagccccggtctcaccttccacatcaaggcagccatccagcaccctcgctacaagcccgtccctgccctggagaacgacctcgcgctgcttcagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaagggtgactcgggcgggcccctggtgtgtggcaaaggccgggtgttggccagagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctcagagc

SEQ ID NO: 138709 - DNA, 6530 bp, Homo sapiens
  Payload ID: 7174
  Gene Symbol: GIGYF1
  Gene Name: GRB10 interacting GYF protein 1
  Uniprot ID: O75420
  ENST ID: ENST00000275732
  CDS Start-End: 1211-4318
cctctgcctggggccccagggatgcgcctcctcctgaaagtcccctccatcctcccttagaggaacaggctgccgccgcgcccccatcagcctccattgccctgaccttatttccacctgatggtgccagaggctgcttcccagctggtatcctgagatcctcgttcccttggtggcttggttgtttaagcctccattattgattgggggcggtggtctgggtgtgattcctgtgggggaaaccagcccgaggtgccttggctcaggcttgcctgcctggagtccttgtcgtgtacccgtctgtggccctagagtcacctcctgctccttttcactgggtttctccccagaccaagcccctggatttgagcttctgagcagccaactgatttttttcatgagggaaagaattttgctcctagatttatttctaatccttttctccgtaactgaccttttctctgtaagctatttgtggctctagtgggtttttgtttgcttgcttgtttttgttttatctttgccctgaacgtccatcctggcctcggctgcctccctccccgagttcttcactacacctcctgtctcagcctcccagagagggtggcgagggtgctgatgcccagagacaccatccggcgaatggacctctcctgtcatgcggggcagggcagggctgccggcagagccatgtcctgaaccctccctcctcccccctgctctccttaagggtctttcccagatgtgaaggtccctcccaggctctactgaggtcagaccaattcccagtggcttgggtaccctcgttcactccagcaccagcccctgccctccttcttcccgggccaggctgccaggtgagccccgggccaagggtggttgccctgctgaggccgaaaggactcgagcttcccatctcctcgcctcccccaggtctttcaccgtctggactcatctctgggtaactcatggtgtgagtggccacgtggctggctcaggtgagtccttttagaccccaggtgacccaccagctagtccggggcccattgttgtgcccactaggatgtcccccatggtgtcctccctgcgctttaaagttctccttcgtgtgctgttcttcatggcccctgttcccccacaggtgtttggacagtgaacgccaggtcccctcctccccacccccggcctctcaaacacgcccagccccacgatggcagcagagacactcaactttgggcctgagtggctcagggccctgtccgggggcggcagcgtggcctccccacccccgtcccctgccatgcccaaatacaagctggctgactaccgttatgggcgagaggaaatgctggctctctacgtcaaggagaacaaggtcccggaagagctgcaggacaaggagttcgccgcggtgctgcaggacgagccactgcagcccctggctctggagccgctgactgaggaggaacagagaaacttctccctgtcagtgaacagcgtggctgtgctgaggctgatggggaaaggggctggcccccccctggctggcacctcccgaggcaggggcagcacgcggagccgaggccgcggccgtggtgacagctgcttttaccaaagaagcatcgaagaaggcgatggggcctttggacgaagcccccgggaaatccagcgcagccagagctgggatgacagaggcgagaggcggtttgagaagtcagcaaggcgggatggagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctgatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaagaagggccccaaggagcccattcctgaggagcaggagctggacttccaagggttggaggaggaggaggaaccttccgaagggctagaggaggaagggcctgaggcaggtgggaaagagctgaccccactgcctcctcaggaggagaagtccagctccccatccccactgcccaccctgggcccactctgggggacaaacggggatggggacgaaactgcagagaaagagcccccagcggccgaagatgatattcgggggatccagctgagtcccggggtgggctcctctgctggcccacccggagatctggaggatgatgaaggcttgaagcacctgcagcaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgagggcttccagccgctgggcgaggtgatcaagatgtggggccgcgtgccctttgccccagggccctcacctcccccactgctgggaaacatggaccaggagcggctgaagaagcaacaggagctggccgcggcggccttgtaccagcagctgcagcaccagcagtttctccagctggtcagcagccgccagctcccacagtgcgcgctccgagaaaaggcagctctgggggacctgacaccgccaccaccgccgccgccacagcagcagcagcagcagctcacggcattcctgcagcagctccaggcgctcaaaccccccagaggcggggaccagaacctgctcccgacgatgagccggtccttgtcggtgccagattcgggccgcctctgggacgtacatacctcagcctcatcacagtcaggtggtgaggccagtctttgggacataccaattaactcttcgactcagggtccaattctagaacaactccagctgcaacataaattccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgcggcagcaggagctattgctgaagttgctacagcagcagcaggcggtccctgtgccccccgcacccagctccccgcccccactctgggctggcctggccaagcaggggctgtccatgaagacgctcctggagttgcagctggagggcgagcggcagctgcacaaacagcccccacctcgggagccagctcgggcccaggcccccaaccaccgagtgcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttatttttttttttaattttaaacgactgaagaaaacattaggagaggcaaaaatattgttaaaaactagactctaaacaccccttcctgctgtgaggatagtgggtgtgacaatggaaggtccacagaggtttttgttttttggttttttttttttttttaagaaaaaaagatgaaaaatgaaaaaaaaaatggttaggaggctgaaagaaaaaacacactgttattttggggcagtggggacacaggccccgtggacctgtcctgcctggcccccaaggccatacttaccccccagaaggcgggccatggggtaactggaagctgggggccagcagtttgcacaggaggcctgtctgagccccacccgccagacctgttgtgagcagctcctgtcactgaggctggctgaggtgtccggggtggggccaaagtagccccttggcttcgctgctttgggggacagttgcacaaattggacgagtggccccagctctctggctgccatcttgtgctggccgagtagacgggaggggccaagccgtgccaacctctctggctggcagggtggggcagcaggactctggttctggtgaggggcgtctcccactgctgccattttgggggacaccctgggtttgaacctgaaagccccagctctctgccttgccacgtgaatgtattctttgggccacaagcccccgcctcacccctgcctgagctgcctcacccctgtgagcggcgggggtggatgattgctccagaggctgcagagagaaggctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccctgttgctgtccttccccggccccggtcttcctgggccctcgctgctcccctgcccttcctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctccc

SEQ ID NO: 138710 - DNA, 5847 bp, Homo sapiens
  Payload ID: 7175
  Gene Symbol: GIGYF2
  Gene Name: GRB10 interacting GYF protein 2
  Uniprot ID: Q6Y7W6
  ENST ID: ENST00000373563
  CDS Start-End: 196-4095
gacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaa

SEQ ID NO: 138711 - DNA, 5978 bp, Homo sapiens
  Payload ID: 7175
  Gene Symbol: GIGYF2
  Gene Name: GRB10 interacting GYF protein 2
  Uniprot ID: Q6Y7W6
  ENST ID: ENST00000409547
  CDS Start-End: 312-4211
atcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 138712 - DNA, 5976 bp, Homo sapiens
  Payload ID: 7175
  Gene Symbol: GIGYF2
  Gene Name: GRB10 interacting GYF protein 2
  ENST ID: ENST00000409480
  CDS Start-End: 263-4228
gtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtaggaaagaagaatggatattattgcatgtactcaccagttcttttgctgggtcagcctttatgccaagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaat

SEQ ID NO: 138713 - DNA, 5747 bp, Homo sapiens
  Payload ID: 7175
  Gene Symbol: GIGYF2
  Gene Name: GRB10 interacting GYF protein 2
  Uniprot ID: Q6Y7W6
  ENST ID: ENST00000409196
  CDS Start-End: 99-3980
gttgttgaggctgaggactgactggggttctgagactccctgtcccggaccgcaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 138714 - DNA, 5937 bp, Homo sapiens
  Payload ID: 7175
  Gene Symbol: GIGYF2
  Gene Name: GRB10 interacting GYF protein 2
  Uniprot ID: Q6Y7W6
  ENST ID: ENST00000409451
  CDS Start-End: 227-4189
ggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtaggaaagaagaatggatattattgcatgtactcaccagttcttttgctgggtcagcctttatgccaagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaat

SEQ ID NO: 138715 - DNA, 957 bp, Homo sapiens
  Payload ID: 7175
  Gene Symbol: GIGYF2
  Gene Name: GRB10 interacting GYF protein 2
  ENST ID: ENST00000410033
  CDS Start-End: 428-957
gtgtatgacagtattttatcaaccatgtgccagaggggcttacctttaatacaggaaattatgataagtaaactgttttcacttttaaaaatcaagttattagcaaaaccactagcttagatctgggtagacattataacaggcattcagagtattttaaggaagtggtaggtagatagaaacatactgaagttaatgtttgggtagagttaggatggttttataccaactcttcatggctgcctcttgggtgggttttctgtcattagtgggcattgtttacatcacaaggtctagacaattttcattagtctgtgacctgggccagatgttatagttctctaaaaggcatcactgcattttatgctgagcttgtccgtaggcagagggtttgtagactatgttcccaacaagcattcagtgaagaatggataggatctgggctgagagagaaaagaaattccagctggtcaaaaacaaacaagatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttga

SEQ ID NO: 138716 - DNA, 566 bp, Homo sapiens
  Payload ID: 7175
  Gene Symbol: GIGYF2
  Gene Name: GRB10 interacting GYF protein 2
  ENST ID: ENST00000458528
  CDS Start-End: 70-249
attttatgctgagcttgtccgtaggcagagggtttgtagactatgttcccaacaagcattcagtgaagaatggataggatctgggctgagagagaaaagaaattccagctggtcaaaaacaaacaagatggccctcgttctgcaggctggcgggaacacatggaacgacgtcggagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattcctt

SEQ ID NO: 138717 - DNA, 564 bp, Homo sapiens
  Payload ID: 7175
  Gene Symbol: GIGYF2
  Gene Name: GRB10 interacting GYF protein 2
  ENST ID: ENST00000421778
  CDS Start-End: 295-564
agcattgaaaaaagaaaacatgagatacagtaaagaaaaagtagctgcataactggctgggtgtatttaatacattaaaaaatggataagtcttattctgtcagtcctgtttcagagatctgaaaattgtcaatgctttgtccattgatgtggatatccaggtcagtcctgtttgggcttttagaaaccagaggagttggaaattcagggacagtcttgtcaaaattctccatcttgatttgatattcacctttggaacctcgggtcaacagagatgcaaaacagtgatgtaacatgatttcagacgggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagat

SEQ ID NO: 138718 - DNA, 588 bp, Homo sapiens
  Payload ID: 7175
  Gene Symbol: GIGYF2
  Gene Name: GRB10 interacting GYF protein 2
  ENST ID: ENST00000445650
  CDS Start-End: 231-588
acatttgagtaggagggctggggcatttgaagccttgcgatgggaactgtgtgaaggaaatggagctgtttagataggagacaagattgtggacagggcagagtggggaggagggcttatagggtcactctctatcaatacctgcctactaatcatgatcatgtgagtttccaaaggaacgtttaaagttagttccgaagtagtcttcctgatcatgtgtgcaagacttcatgaccaagctcccagatgatccagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggt

SEQ ID NO: 138719 - DNA, 606 bp, Homo sapiens
  Payload ID: 7175
  Gene Symbol: GIGYF2
  Gene Name: GRB10 interacting GYF protein 2
  ENST ID: ENST00000429187
  CDS Start-End: 288-606
ggactgactggggttctgagactccctgtcccggaccgcagcgttaaaaggatctgaacaaagtctgctcaaatctcctgctgtgaaccagcagaatttttgaacagatgctgcttgaatctggggcttcgtttatatttcaagactgctgcctgtaggagctccatctgtatcatttgtgttaatagtgaccctggagttttgtacttccagaacctatgtgagcatatgtgatggccttgtagtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggac

SEQ ID NO: 138720 - DNA, 556 bp, Homo sapiens
  Payload ID: 7175
  Gene Symbol: GIGYF2
  Gene Name: GRB10 interacting GYF protein 2
  ENST ID: ENST00000455139
  CDS Start-End: 371-556
attgaaaaaagaaaacatgagatacagtaaagaaaaagtagctgcataactggctgggtgtatttaatacattaaaaaatggataagtcttattctgtcagtcctgtttcagagatctgaaaattgtcaatgctttgtccattgatgtggatatccagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaa

SEQ ID NO: 138721 - DNA, 530 bp, Homo sapiens
  Payload ID: 7175
  Gene Symbol: GIGYF2
  Gene Name: GRB10 interacting GYF protein 2
  ENST ID: ENST00000427233
  CDS Start-End: 491-530
gtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagatactgtagctaagtgcaacaaggtgtcctgaattggagactggcacagaacaaggatgttgttggaaaaactgatgaaatctgaataaactctgaagtatagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactttgggcctgaat

SEQ ID NO: 138722 - DNA, 561 bp, Homo sapiens
  Payload ID: 7175
  Gene Symbol: GIGYF2
  Gene Name: GRB10 interacting GYF protein 2
  ENST ID: ENST00000430720
  CDS Start-End: 224-561
atcttgtgttgttgaggctgaggactgactggggttctgagactccctgtcccggaccgcagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagt

SEQ ID NO: 138723 - DNA, 677 bp, Homo sapiens
  Payload ID: 7175
  Gene Symbol: GIGYF2
  Gene Name: GRB10 interacting GYF protein 2
  ENST ID: ENST00000427649
  CDS Start-End: 249-677
gaactgacttggagaaggggtgcattttttccctctaatcaggaccggtctttaggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagca

SEQ ID NO: 138724 - DNA, 626 bp, Homo sapiens
  Payload ID: 7175
  Gene Symbol: GIGYF2
  Gene Name: GRB10 interacting GYF protein 2
  ENST ID: ENST00000424038
  CDS Start-End: 113-391
cagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaa

SEQ ID NO: 138725 - DNA, 547 bp, Homo sapiens
  Payload ID: 7175
  Gene Symbol: GIGYF2
  Gene Name: GRB10 interacting GYF protein 2
  ENST ID: ENST00000436349
  CDS Start-End: 362-547
tggggcatttgaagccttgcgatgggaactgtgtgaaggaaatggagctgtttagataggagacaagattgtggacagggcagagtggggaggagggcttatagggtcactctctatcaatacctgcctactaatcatgatcatgtgagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaa

SEQ ID NO: 138726 - DNA, 583 bp, Homo sapiens
  Payload ID: 7175
  Gene Symbol: GIGYF2
  Gene Name: GRB10 interacting GYF protein 2
  ENST ID: ENST00000424414
  CDS Start-End: 370-583
gggtccacacatttgagtaggagggctggggcatttgaagccttgcgatgggaactgtgtgaaggaaatggagctgtttagataggagacaagattgtggacagggcagagtggggaggagggcttatagggtcactctctatcaatacctgcctactaatcatgatcatgtgagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaag

SEQ ID NO: 138727 - DNA, 564 bp, Homo sapiens
  Payload ID: 7175
  Gene Symbol: GIGYF2
  Gene Name: GRB10 interacting GYF protein 2
  ENST ID: ENST00000421433
  CDS Start-End: 285-564
atcttgtgttgttgaggctgaggactgactggggttctgagactccctgtcccggaccgcagcgttaaaaggatctgaacaaagtctgctcaaatctcctgctgtgaaccagcagaatttttgaacagatgctgcttgaatctggggcttcgtttatatttcaagactgctgcctgtaggagctccatctgtatcatttgtgttaatagtgaccctggagttttgtacttccagaacctatgtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttcca

SEQ ID NO: 138728 - DNA, 544 bp, Homo sapiens
  Payload ID: 7175
  Gene Symbol: GIGYF2
  Gene Name: GRB10 interacting GYF protein 2
  ENST ID: ENST00000428883
  CDS Start-End: 199-544
acgtgcgtggcgacgtgtcggccatcttgtgttgttgaggctgaggactgactggggttctgagactccctgtcccggaccgcagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtggggg

SEQ ID NO: 138729 - DNA, 2329 bp, Homo sapiens
  Payload ID: 7175
  Gene Symbol: GIGYF2
  Gene Name: GRB10 interacting GYF protein 2
  ENST ID: ENST00000423659
  CDS Start-End: 170-2329
cttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaagg

SEQ ID NO: 138730 - DNA, 588 bp, Homo sapiens
  Payload ID: 7175
  Gene Symbol: GIGYF2
  Gene Name: GRB10 interacting GYF protein 2
  ENST ID: ENST00000425040
  CDS Start-End: 290-588
atcttgtgttgttgaggctgaggactgactggggttctgagactccctgtcccggaccgcagcgttaaaaggatctgaacaaagtctgctcaaatctcctgctgtgaaccagcagaatttttgaacagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgc

SEQ ID NO: 138731 - DNA, 2658 bp, Homo sapiens
  Payload ID: 7175
  Gene Symbol: GIGYF2
  Gene Name: GRB10 interacting GYF protein 2
  ENST ID: ENST00000440945
  CDS Start-End: 151-2658
ggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaa

SEQ ID NO: 138732 - DNA, 466 bp, Homo sapiens
  Payload ID: 7175
  Gene Symbol: GIGYF2
  Gene Name: GRB10 interacting GYF protein 2
  ENST ID: ENST00000456491
  CDS Start-End: 263-466
gtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagaggtgaatgtggtttctaccaaagaagttttgatgaagtagagggtgtttttggtcgaggaggtggcaga

SEQ ID NO: 138733 - DNA, 561 bp, Homo sapiens
  Payload ID: 7175
  Gene Symbol: GIGYF2
  Gene Name: GRB10 interacting GYF protein 2
  ENST ID: ENST00000426102
  CDS Start-End: 114-561
gtttgagagactcagcacctccagttcctgagccttctttgtgaatctgcctgtttctgagctcctttacttagatttcaatttattagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagt

SEQ ID NO: 138734 - DNA, 7878 bp, Homo sapiens
  Payload ID: 7175
  Gene Symbol: GIGYF2
  Gene Name: GRB10 interacting GYF protein 2
  ENST ID: ENST00000629305
  CDS Start-End: 198-4163
gtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtaggaaagaagaatggatattattgcatgtactcaccagttcttttgctgggtcagcctttatgccaagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattctatctgagtgcacctcttgtactcacctttatggaggctgagttctgcactaaactgttcctcttggtaccatggaaaagctccaagcacccaagacatggaggcagccatggcttctttctctgccagaccacgtagcactggctggttctgtatttgagaatgtagaggtcaaggcagatgtcggtaagtttgaccaaatatcttttctctttttgactctccctttctgctaacatgtggatcagctcctgccctcataccgcagacacacccactctgaacacacccctccagagcttgcccacaccttcccaactagactctgtgtgtgtattcaggaaaaatgaaaataaatttttaaaaattgggagtggaatgggcagattagggggaacaaagtcattttggtcatggaacatccatttgcttaaccaaggagacttgcttctatctgaggaatttcccacttagtagaaagaaacactcttccctgggaatgtttgtttctgtctctctcaatgctactctctttcatattctcatttgctcaccctttcacttagagccaccgttttctcatcccattctatgaacttatttccaaattctcctaactattcctgagttttgaagtatttgttttgtaccctctctgcttccggttttttgtttggttggcttttttggagatagggtcttgtgatgttgcccacactggtctcgagcccctgggctcaagtgatcctcccgcctcagcctcctaaatatctaggactacaggtgtgtgccaccatgcccagctccagttttgttggttgatttgtttaaattcagagatttaaaaacatcccagacaagacagtttgattatggagactgtccccaagcagattggtgtgctggtggctgctgtgcataacagattccctccagattggcttacaacagctacttcattctgtgggtcaggaatttggatagggctcagctgggtggtggttctcctggggtattctttggttgtggtcagatgtcttccagggcatcattcctatgaaggcttaatgaattaggcaagctgtccaagatggctcactcgtgtaatgacagttgacgttggctgtaggctgggaactcagctgggttgatgactggaggagcttatgtgtgtcgtctccggaatggcagcttcagaggagttgaacttaagtggtgattggcttcccccagagaaccaggcagaagctgtgttacctttttgagctcttagctcaggagtcacatagagtcacttctgtgacactgtgttgcatcaaagtagtcacaaacccactcagattcaagagaagggagcatggccctctccctgcaaccccctccccccccgccttgatgaaaggagtgacaaggtcacattggagaagagcttgtggggtgggagatattatagccatttttgggaaatatctgcataaaatgagtttatgcatacatgaaggactttattttcattggctttaagttgagggtttttgtttttgtttttgtattggagatgggttcttactatgttgcccaggctggtctcaaacccctgggctcaagtgatcctgttgcctcagcctcccaagtagctgggactacagctatgtgccagtgcacccagcttgttttttttaaattttaggatagataatggtacttctggctttatttaaataatttttttagggaaaccattgtatttatacatgcatatatttttatatatacaaatatgtatataaaagtatatgttttacattttcaatatatatataatatatacatatatgttatatacgtatatatattgcaccctactttaaaattgactgataacaaaattggtaattttgtataaaatgcccaactgtgcattattaataaaagtatgtgaatgactct

SEQ ID NO: 138735 - DNA, 3006 bp, Homo sapiens
  Payload ID: 7176
  Gene Symbol: GAREM
  Gene Name: GRB2 associated, regulator of MAPK1
  Uniprot ID: Q9H706
  ENST ID: ENST00000269209
  CDS Start-End: 5-2635
gaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcagcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaacacttggaggtgtgccttgtacgtcactcaacaaacactcagcagctgctaaaagaaaaaaaggcatgtgcagagaaatcattcttacccaagtaggtttatgtgagaaggtatgatatttattacaaaatagccaaagctggaagacataaaaatctttaaaaaaaaaaaaaaaa

SEQ ID NO: 138736 - DNA, 7033 bp, Homo sapiens
  Payload ID: 7176
  Gene Symbol: GAREM
  Gene Name: GRB2 associated, regulator of MAPK1
  Uniprot ID: Q9H706
  ENST ID: ENST00000399218
  CDS Start-End: 57-2684
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaacacttggaggtgtgccttgtacgtcactcaacaaacactcagcagctgctaaaagaaaaaaaggcatgtgcagagaaatcattcttacccaagtaggtttatgtgagaaggtatgatatttattacaaaatagccaaagctggaagacataaaaatctttaaaaaaaaaaaaaaaacacttttgaacaagtcccttctttcaggagggttgactttagacaattaactgtgttctgtgctctgtcattcagattgcttcttgctaattgttttactcttgtgcctgaaaatgttagtgatacgaattgacactttaatgttgtatgcttggtggggatctttttatcacaaggcattttccaagagtcatatgttgataaagggatatatgttgtccttagaaatcacacaaatcatgaccacaataatttatctgtaactgctgctaattttattgagcagagaaaaaagaatatacatatataaacatgtataggtgcatacacaatacacccggatatgttttacacataattttgattctgatattttagataacatctgttcacttttaaacaatctgttgaggttttgggactgttatctacattgattctcttaggaatagtggacagaatgactccaaagattctcagaaccctgtctcttgaagctcaatcttatttgggttcatcactgaaaacttagaacaaatcagtaaagaatcctgtattgaagaattaagtttgagtttaagcccactcaccgcagggctggtttttgcatgtaatactcccatgatgtctggggaaatgacagtttctgttgaattataattctccggtttaagggtctccttcccctggtgtctgatggtgagaggtctgaagagcatttgtcagagtacattaggcattctcaacctacttcatgctttacgagagctgagaaatcagacgcaccggcctttattattatatatgctacatctgttgagtatttttaaaataccaataagaggacttgtttatttcataaaccacttcttccctctctttcaaagaaaatacattattaccatacttttacattagtctgagaatttttgctaaatatgattaagtattccaaaatataatggcgtcattattcttgacttttttagagaatatacatcttaagactgtattagttctcagagcaaggcatcatctactcccctgcacctgagagtctggccccagattccagatgtgcggacagcccatgaccgaggtgcacacagtgccctcttgaataggaaggtcagccagtgaggcggcagcataacttgcaggatggacttatatcttaccatctcttcctgctaccaaaataaaaaaataaattgaaagacaagacccaccagtctagttttgtagacctgtgaaatgtgtctttatttcttggcattagaagaaagatatttttaatccatatcgtggttttagagttgaagtgaattgatacccaattttccatcttagatctcctttatcaaaaaaaaaagcattttttttctcctaacgtgtctcccaaaatgtaaatactataggcaaaaagagtaccctgtaaaattctcacactggagcacctcttcaaaagtcacagataactcaatgaggaagtgctggtactgcactcacaggacatgagacctatgaagctttcgtgttttgaaagcatccttctgtgtgagggggactgcctcccttagtaaagtaaacctctcagaacttctttttaaaataaaaacagacaagatgcagttactaagctgcaagttttcattggcaaacctagctgaatccgttttaaaatacttagcactcggacacaattctcaaactcaggaagaaggaacagggttggtttgggtttactataaaggttgcctcacataaacaactgactccttttagcgttttttttctttttgtaaaaactttacacaaaatagggttttaaattctttttgcttgttttggacttggtgtatttttgtcaagtttatattgattggcaacgcagagactccttgagggcagggactgtggcctttgattcacttatgctacagtctagtatcactacagtgctgagtaaaagacacagcccctgccctcttggagatcatattgtttatatttgaaatctcagttgctaagagtatgtatgtgtgagtaagaaagacgtgaagtcctatgggcagctgggtatatggagaattacgtgtgtcctgtctttaaaacgtcagcctctattaaggggtacagaacaccccaagatcactaaaacttggaatgtgttggaggcagaaagtatctctctcattgcctagtgttgttgtttttttgttttttgttttttgttttttttactgacctggaattcttttaattgtaataaatatcttctgtcacaaataaatgccacaaataaatgaaattgccattcctaagctgagcacctgtctgtgaaggaccttggtgtcctgactggacagagcattcatagctccaagagaatcatgacaagatatgcaaagcagggataataaggagaaagcccttccctttcgagaagcccttccctttcacagcccttccctgcgattctgcagtgaaaagtgatgcccagagatccacacacagaacccttctaaccagccaggtcaagacttatcatcttatctcctctggcaggtcccctgtaatcaaaagagaggaagtgtctatctaaacaagacccttttgggtccttagattcatggcaaaaatcatcatggcccccatcagaaaagaaaatcagcaataaaccaagccaagcaactaaaatgtataatgtggacctgactcatgttgggaggcagaattcagacactcacagatcaatcttgcaagttttctcttctttaagttgagctgctcaactttatgaactgtgaaatttacttacattctttcaacccacatatatcattgcagtttatgaagttgcagtgaactgcccattcagctaaattgcagtgtttattcttgtctcatgtcgaaatacaacaatcttatgggaaatattatgacagtccgttccaactgttctcagacacatgcataaacagtctctgctcacattccacagccacctgcatgttatccatacagctccctgagaagtccagggatgggaggtggggtgtggaaggatggagggtccttcattttctaaacactttgtataagtcactactcatcgtgcctagcaagtataagattaacattttgaataacaaactggaaaacaaataatccttcaaagaacctagcgaactgttcaaaggaaattttaatttcagtctaccagaaaagttaaatctgttgttggacgtagggggctttcagaaacatgcctcttatatcaatttccactatctttcaagttacctaaaggcaccaggctgcttgagcaagaagaataaaaggcctagagtgcaaattatgtgaagtagagtttttagattgtgggattgtaataatacgggattctcatggttacatcatgttaaatcacactgttcagtctttaaaacttggtgttttaaaatttgtctcattgtgatagccagaaacaaggaataaacgtgatttcagtttaaactatatacaaatatcttctgtaattttgctgctctaatttttaggctataaattttgtaatagagcttatcagatcgcaaatttcctttgtttacaatctcatgtagtagggctcagataatttcttagctataaaccttttctcccactctcatattgtttcatttaaaatatttaagctaagcctaaaaattgaaatcagttaagaatttggagagtttatcttaaatggaaatggtgtattcttttcaaagaattttgtaaccatctttacagtttctttgcttggaaaacttgggttgttaactaccagttaacaatggcattactttccaaaacgttatctaatgggcccaatgtgtacctcaagataaacacagtatgttatgtctaaaaatttccttgtctgttgatttaaatggttctgaaatgtctgtaataaagaaattttcaaagttg

SEQ ID NO: 138737 - DNA, 506 bp, Homo sapiens
  Payload ID: 7176
  Gene Symbol: GAREM
  Gene Name: GRB2 associated, regulator of MAPK1
  ENST ID: ENST00000583696
  CDS Start-End: 1-110
gagcagcagtgaagtcttcagatactgccctacctccacctccagtgcctcccaaatctgaagccagacagggttttatcacattgcccagactggtctcaaagtcctgagctcaagccatccgctcgcctcggcctcccaaagtgctgagattacaggtattttcacctacagcaatctacctgactagatctacttgtctgccatctacagagcaagtaactgaggcctcaatagacaggttgtgctactgcgcaggaatgagttcccggttcatctttcattacttcactcttctccagactgtgctatattacctcacactatgcatctccctttttataatgagagttactgcaattttaaatatctcattttgcttcacagtcatcaatcctttgttgacaaaaatctaccttactgataatgccccaaccaaatataaatcaactactttctcttgcatacatgaagtgaaataaatagaacagcatgttttattctaa

SEQ ID NO: 138738 - DNA, 5138 bp, Homo sapiens
  Payload ID: 7177
  Gene Symbol: GAREML
  Gene Name: GRB2 associated, regulator of MAPK1-like
  Uniprot ID: Q75VX8
  ENST ID: ENST00000407684
  CDS Start-End: 1757-3751
aagcgattcccctgcctcagcctcccaagtagctgggactacaggtgtgtgccaccacacccagagagttttttgtatttttagtagagatggggtttcaccatgttggccaggctggtctcaaactgctgacctcaagtgatctgcccactttggcctcccaaagtgctgggttacaagcgtgagccaccgtgcctggcctgccatctccatttctgaccaggctggtggcctgagtacatcatcctgagtcccttccttccccacctcccccttcttctgtcacccaagcctgctgggtctcccttcccagtatctcttggtctgtttctgctattccctagctcttctccagaaccccttactggtttgtttacctgactggtctcccggttattttaatagagctgaacctggatcatggtatttctttgctcgaaacactccagtgggtctcatgttgtacagaataaagctttactgctttagcaaggcattcagagcctttcaaatcccagttgctgtctgcatcccctcctgtcctccctctccctaagtccttccctgcaggcacgcaccatctggggcaggtggtctgcttttgtgtctctgtgtctgtgtttacagtgtttcttccacagggaatgcccattctgtgaattccctttgattcttaaggtgcagctcagtgatcctctcagattccgccaggcaggttttgcctacctagccgtcttgtaactcttttgtcacaagtctgttgtagcacttatcacatcctgccaccattgggtactcatcgtctcacccattatatctggatttctttaagggcagactgtattttacacagatttgtaccctctgtgtggcctaccatagtgtctgacacatagtgagtgctccatcaatatctgtgcaataattaaatgaatgaactgtgacagaagcaactaccacaggggcttcagaagctaaagaaggcccagcgcggtggctcacacctgtaatcccagcactttgggaggccatagcaggaggattgctcgagcccaggagtttgagaccagcctgggcaacatcatgagacgtcatctctaataaaaataaaaaattagccaggcatggtggcacatgcctgtggtcccaggtacttgagaggctgaggcaggaggatcccttgagcccagaaggttgaagctgcagtgagttgtgatcatgccactgtactccagcctgggcgacagcaagaccctgtctcaaaaaaaacacccagaggctaaagagtcaccttgtcttctctcgacttgttccctcacctattcatggctctcttcctactgtataaagcttgagaagaggccatccatcagatgccagggcggctcagagcttgttttgtgctcatgtgggtatgcatataacaggtgtctggccagtgaggtgagagagcttacacagggatgtcagcttcacagactggcaatcacttccgtaaagtctgtgtctcctaggggcatgtgctgagcttggcaaagcacgcagccccagactgcaggttgggaaggcctactctcagggaggtggctttgctgggttcaggtcagagcctctgggagagtaggattggatattggaccagggcagggtgtgggaacagagctggggtcagagtggttctcccagggccttcaagggctgggccaggccctggttggcccagtgccacctccatgcggatcagcagcccagggcgatgcacaggatgccagatccagggaagttcaagctcctggaacaggcccgggatgtgcgggagccagtgaggtacttcagcagcgtggaggaggtggccagtgtcttccctgaccgcatcttcgtgatggaagccatcaccttcagcgtcaaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcccctacgaggagttgtgggcgcaccaggggcccgagggcctcgtccggccgcccccagggctcgatctcatctccttcggggccgcgggaccgccgcgtcgggagccggaagcgccgccgcctccagtccctcccaaatccgaggcggtgaaggaggagtgccgcctgctcaatgcccctccagtgcctccccggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctg

SEQ ID NO: 138739 - DNA, 4161 bp, Homo sapiens
  Payload ID: 7177
  Gene Symbol: GAREML
  Gene Name: GRB2 associated, regulator of MAPK1-like
  Uniprot ID: Q75VX8
  ENST ID: ENST00000401533
  CDS Start-End: 131-2755
cgcggcccggcggggctgccaggcggcgagcgccgcggcggccccgggaggtggcggcgggcgcgagagcctgggccgcgcgggactgaccgtcggggccccgggacggcggccccggggcgcccatgccatggagaagctggcggccgggctggccggcctgcgctggagcatgggcgccttcccgctcgacctcatcgtcagccgctgccgcctgcccacgctcgcctgccttgggccaggggagtacgccgagggcgtcagtgagcgagacatcctgctcatccactcctgccggcagtggacaacggtgacagctcataccctggaggagggccactatgtcatcgggcccaagatcgacatccccctgcagtacccagggaagttcaagctcctggaacaggcccgggatgtgcgggagccagtgaggtacttcagcagcgtggaggaggtggccagtgtcttccctgaccgcatcttcgtgatggaagccatcaccttcagcgtcaaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcccctacgaggagttgtgggcgcaccaggggcccgagggcctcgtccggccgcccccagggctcgatctcatctccttcggggccgcgggaccgccgcgtcgggagccggaagcgccgccgcctccagtccctcccaaatccgaggcggtgaaggaggagtgccgcctgctcaatgcccctccagtgcctccccggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggtgggcgagtcctctagccgcccagcccccggtcccctaccctcaaccacacagcccagccaggcctcccgggccctcacagagcctctgagcggtcgagccgcctcccttctgggggctgacacccctgttaagacctaccacagctgccctcctctattcaagccctcacatccccagaagcgctttgctccgtttggagctctcaaccctttttccgggcctgcctacccctcaggcccttcagcggccttgtcttctgggcccagaaccacctcgggtcctgtggctacctctggccctgcgtattccccaggcccagcctcgccaggccaggcctattcagctgctcccccctcctcctgcgccccctcctcctcctcttcttctgaatggcaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctgaagatgagtacaagtggca

SEQ ID NO: 138740 - DNA, 2648 bp, Homo sapiens
  Payload ID: 7178
  Gene Symbol: GAB1
  Gene Name: GRB2-associated binding protein 1
  Uniprot ID: Q13480
  ENST ID: ENST00000262994
  CDS Start-End: 303-2387
gagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcg

SEQ ID NO: 138741 - DNA, 7981 bp, Homo sapiens
  Payload ID: 7178
  Gene Symbol: GAB1
  Gene Name: GRB2-associated binding protein 1
  Uniprot ID: Q13480
  ENST ID: ENST00000262995
  CDS Start-End: 428-2602
gtgtgtgtgtgtgtgtgtgagcagcgctgtgtctgtttcggaaagcgctctggggaggtcttgtccctagggggcggagcgcaaaggacagaagctccggcaccgagtcggggcagagtcccgctgagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcatttttttaaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatcctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccataa

SEQ ID NO: 138742 - DNA, 571 bp, Homo sapiens
  Payload ID: 7178
  Gene Symbol: GAB1
  Gene Name: GRB2-associated binding protein 1
  ENST ID: ENST00000511836
  CDS Start-End: 1-283
tggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaaggatctcactttgtcgtctaggctggagtacagtggcatgatctctgctcactgcaacctctgcctcccaggttcaagcgattctcgtgcctcagccttctgagtagctggaattacagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgct

SEQ ID NO: 138743 - DNA, 2477 bp, Homo sapiens
  Payload ID: 7178
  Gene Symbol: GAB1
  Gene Name: GRB2-associated binding protein 1
  ENST ID: ENST00000505913
  CDS Start-End: 324-2099
attactttcctagactctagtcatgaacaggatgttggaagtcagaggtacagagaagctgcctttttaggccgctcacatgaaaggcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataaca

SEQ ID NO: 138744 - DNA, 743 bp, Homo sapiens
  Payload ID: 7178
  Gene Symbol: GAB1
  Gene Name: GRB2-associated binding protein 1
  ENST ID: ENST00000509992
  CDS Start-End: 214-743
caaggacaaagtacactggcttctgaagaaactttttcttgggagcaaggacttgggggtaacaaaatgaggagtaagtgaagaaagaagaaggcacagcttgtcgagattgatggaccgccccccgcccccgggagagcagcgtaggaaattgcaggatgaaatttgtgtgccagtcttgtcagcacccattcctgttgaaggagagggcatatggatgaggcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccag

SEQ ID NO: 138745 - DNA, 470 bp, Homo sapiens
  Payload ID: 7178
  Gene Symbol: GAB1
  Gene Name: GRB2-associated binding protein 1
  ENST ID: ENST00000512843
  CDS Start-End: 1-275
atcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattg

SEQ ID NO: 138746 - DNA, 582 bp, Homo sapiens
  Payload ID: 7178
  Gene Symbol: GAB1
  Gene Name: GRB2-associated binding protein 1
  ENST ID: ENST00000515366
  CDS Start-End: 438-582
aaaaattatagaggatctgcagactgagacgcattgggactgaaattaggcaattcagagtttctcatgcatagtctcactgtgttgcccagattggtcttgaactcctggcctcaagtgatcctctttccttgccctcccaaagtgctgggattacaggcttgagccaccactcccagccaacagaattcttttcaacagcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcag

SEQ ID NO: 138747 - DNA, 728 bp, Homo sapiens
  Payload ID: 7178
  Gene Symbol: GAB1
  Gene Name: GRB2-associated binding protein 1
  ENST ID: ENST00000514639
  CDS Start-End: 12-728
acgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagccaagggtcatcttttgtttctgaagaaggagaggaataccttctactagaagattttgaaagcaaaacgattccattgcaaacgcatgctgattctgcaaaatccacctcttctgaaacagac

SEQ ID NO: 138748 - DNA, 6052 bp, Homo sapiens
  Payload ID: 7179
  Gene Symbol: GAB2
  Gene Name: GRB2-associated binding protein 2
  Uniprot ID: Q9UQC2
  ENST ID: ENST00000340149
  CDS Start-End: 161-2077
gaaattttgagaagtggtgggatgaagaagatccctgaagagaggagtaactgagacaaaggcgaggctagcaatagagagacaagtgagggaattagacctttggtatcatcatgaaaaggcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgtaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcacccc

SEQ ID NO: 138749 - DNA, 6092 bp, Homo sapiens
  Payload ID: 7179
  Gene Symbol: GAB2
  Gene Name: GRB2-associated binding protein 2
  Uniprot ID: Q9UQC2
  ENST ID: ENST00000361507
  CDS Start-End: 87-2117
gagctgcgcaccgccggccgctgccccagctgcccgagcccgcgccctcgtccgcgcgacccggcggggggctccaggccggcagcatgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgtaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcacccc

SEQ ID NO: 138750 - DNA, 567 bp, Homo sapiens
  Payload ID: 7179
  Gene Symbol: GAB2
  Gene Name: GRB2-associated binding protein 2
  ENST ID: ENST00000530915
  CDS Start-End: 262-567
agctgcccgagcccgcgccctcgtccgcgcgacccggcggggggctccaggccggcagcatgagcggcggcggcgacgtggtgtgcaccggctggctgaggaaatcgcctcccgagaagaagttgaggcgctattaccttctgtctgacttcaaccccacatctgcttgacaagaattaactcaaatatctcttcttaacacctacctgattctggcatacagcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctct

SEQ ID NO: 138751 - DNA, 543 bp, Homo sapiens
  Payload ID: 7179
  Gene Symbol: GAB2
  Gene Name: GRB2-associated binding protein 2
  ENST ID: ENST00000528886
  CDS Start-End: 152-543
gtagtaggtccgtctcctcctcccgccgagggacgccagagttaaggagcttcttgctgggaaggggtccctcctttcagccggaacctgacccgcagaatgtatcggaaatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactct

SEQ ID NO: 138752 - DNA, 3704 bp, Homo sapiens
  Payload ID: 7180
  Gene Symbol: GAB3
  Gene Name: GRB2-associated binding protein 3
  Uniprot ID: Q8WWW8
  ENST ID: ENST00000369568
  CDS Start-End: 49-1695
tgccgcgggcggctggcccagctggaggaagcggcggcggcggccacgatgagtgcgggcgacgcagtgtgcaccggctggctcgttaagtcgccccccgagaggaagctacagcgctacgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcagcagattccatggagagcctctcttacacgccctcctccctgcagccatcctctgccagctcccttcttaccgcccatgctgccagctcctctttgccaagagatgacccaaacactaatgccgtagccactgaggaaaccagaagtgagtcagagcttctcttccttccagattatctggttttgtccaactgcgagactggaagactgcaccataccagtctacccaccagatgtgatagctggtcaaactcagaccgttcattggaacaggcttcatttgatgatgtttttgttgactgcctgcagccgctcccctccagtcatttggtccacccctcatgccatggcagtggagctcaggaggtgccatcctcgaggcctcaggctgccctgatctggagtagagaaatcaatgggccacccagggaccacttgtcttcttcaccattgctggaaagttccttaagttccaccattcaggtagataaaaatcaaggttccttaccctgtggagcaaaagaactagacattatgtccaacactccacctccccgcccccctaagccaagccatctgtctgaacggcgccaagaggagtggagtacacacagtggtagcaagaagccagaatgcactctggttccaagaagaatctccctctctggtttagacaacatgagaacctggaaagctgatgtagaaggccaatccttaagacaccgagacaagcggcttagtttgaatttgccatgcaggttctccccgatgtaccccacagcttcagccagtatcgaagacagctatgtgcccatgagcccccaggctggtgcctctggtcttggaccccactgcagccctgatgactacattccaatgaactcaggaagcatctcaagcccgttgcctgagctgcctgcaaacctggaacctcccccagtgaatagagatctcaagcctcagaggaaatcacggccacctcctctggacctgagaaacctctcgatcatccgggaacatgcatctcttaccaggacccgcactgtgccttgcagtcgaaccagctttctctctccagaaagaaatggtattaattctgcaagattttttgctaatcctgtttccagagaagacgaagaaagctacatcgaaatgaaacttctcctttcagaagaacaaagagtagactatgtccaagtggatgagcagaagacacaggctctccagagcacaaaacaggagtggacggatgaaaggcaatccaaagtatgagaggtgcgggcttgtgccatgtgtgaaacagggaagcttggggctcagtttgagttttttcttttttttttttttttgtccactaaaaacacactgatggtcaacacaggtcaaaaccaagagagaatgtgtagttttcaaggtcttggccagaacctttaggaaagaagacctgtttatacattgaaggaagaaaagaaggaagcagttgccttccggagggggctctgagagaatctagcctcccctctgtcctattggagcaaagattggagtgagtgttgccaccaacaggattttatcgtttgactccaatacctgaaattctgacttctctcctgtgcttcaatgagaatgataaattatcctagcaaaggggcctctggagaccatcttgttccagcctctgaagacagttgaggagatcaagcccagcaatggtggcagaatcttactccacagacttcagcagactagtcatttcaatacccaaagaaagacaagtgacaggggcaatggatctcaggctctgagataagtatatcagatgacactggtggctctaaggatattgcaattaagcagctacctgtagccaggtattctgctgctcttggccttttcccacgcatcgtctcgtgtcttctccgaaagaccttggaagataggcctggaagagactgttgatgccactttgaagaaaagaacactgagaactagaggagggaacactttgcccaagattactcacaaagccaagacccagagtccagcttagagaatagagttgttcaggctgccaattgcaagctcattcctctacctcatacttcctctgaggattttgacaaaatggattaattgggtgagccttggagacatgtgggaaacacctgcagacacaaaatgagtagtcatcctgtctccctttcaatagggatctgaacaggtgttttgatacttgaaagatgtgcatgtcaagtgagggtttctttctgcgatgttcaactggaactctcccatcagtagttacaattagaaatacctactgatggttagtctgaaggccattctcatggtcacctatacagtgtgtttccctgtgagctagcagacacaatgaccaggaaaaaacctatgaattccattcttaggtttcccagccaattgctcccttctgctttagaagtgactaggtactgagagtacaaacactcccactttataatgaaggcgtcatgtcaccccttcctttacaggtcctggggtccaggagacccagaatgaaggtgtcagttgggcatgaagtgttatttagtgtccattcttgatccttctgagcacctacagctggaaactaagcagatactggtcctgcattctgactgagattgtgtcttctttatgaggatagatcaaattggcagtcaggcccatgatagtcagtgcagttggggcagttgtagactttgctacaggatttcagggtttccaatcaccccacaggtaagtgaatgccaaagtcttcttttttcagaccatacaagaagtcattttgattttcaaagaagccgttttgattttcaaagaagcaggttctggtgacattattttcttccttggacaaagtggggggaaatttctaagtattttaactgagttcagggtccttagtgagcctggacagagcaaggagagggctccccactccctaagccccacagccagctctgcatcaccacacacagccagagcctgtgaggagctgccttcttccccatgtgacttgcaaagagtctcaggcaagaaaccagggcttcaaactgctagttcccatggagggtagttccctcgtgtggagcacttgtgttaggatcactgattatctgacaaaggctggtgcagaaaaaaaattgtaggcccaagtgtcaagaaccacaccagattggagatagaaaagaatagctgaaattatgtcagtagtgaaatgtcactccattgacccaccg

SEQ ID NO: 138753 - DNA, 4718 bp, Homo sapiens
  Payload ID: 7180
  Gene Symbol: GAB3
  Gene Name: GRB2-associated binding protein 3
  Uniprot ID: Q8WWW8
  ENST ID: ENST00000369575
  CDS Start-End: 33-1793
cccagctggaggaagcggcggcggcggccacgatgagtgcgggcgacgcagtgtgcaccggctggctcgttaagtcgccccccgagaggaagctacagcgctacgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcagattccatggagagcctctcttacacgccctcctccctgcagccatcctctgccagctcccttcttaccgcccatgctgccagctcctctttgccaagagatgacccaaacactaatgccgtagccactgaggaaaccagaagtgagtcagagcttctcttccttccagattatctggttttgtccaactgcgagactggaagactgcaccataccagtctacccaccagatgtgatagctggtcaaactcagaccgttcattggaacaggcttcatttgatgatgtttttgttgactgcctgcagccgctcccctccagtcatttggtccacccctcatgccatggcagtggagctcaggaggtgccatcctcgaggcctcaggctgccctgatctggagtagagaaatcaatgggccacccagggaccacttgtcttcttcaccattgctggaaagttccttaagttccaccattcaggtagataaaaatcaaggttccttaccctgtggagcaaaagaactagacattatgtccaacactccacctccccgcccccctaagccaagccatctgtctgaacggcgccaagaggagtggagtacacacagtggtagcaagaagccagaatgcactctggttccaagaagaatctccctctctggtttagacaacatgagaacctggaaagctgatgtagaaggccaatccttaagacaccgagacaagcggcttagtttgaatttgccatgcaggttctccccgatgtaccccacagcttcagccagtatcgaagacagctatgtgcccatgagcccccaggctggtgcctctggtcttggaccccactgcagccctgatgactacattccaatgaactcaggaagcatctcaagcccgttgcctgagctgcctgcaaacctggaacctcccccagtgaatagagatctcaagcctcagaggaaatcacggccacctcctctggacctgagaaacctctcgatcatccgggaacatgcatctcttaccaggacccgcactgtgccttgcagtcgaaccagctttctctctccagaaagaaatggtattaattctgcaagattttttgctaatcctgtttccagagaagacgaagaaagctacatcgaaatggaggagcaccgaacagccagttccctgagcagtggtgcccttacgtggacaaagaaattcagcctagattatttggccctggacttcaattcagcatcaccagcccccatgcagcagaaacttctcctttcagaagaacaaagagtagactatgtccaagtggatgagcagaagacacaggctctccagagcacaaaacaggagtggacggatgaaaggcaatccaaagtatgagaggtgcgggcttgtgccatgtgtgaaacagggaagcttggggctcagtttgagttttttcttttttttttttttttgtccactaaaaacacactgatggtcaacacaggtcaaaaccaagagagaatgtgtagttttcaaggtcttggccagaacctttaggaaagaagacctgtttatacattgaaggaagaaaagaaggaagcagttgccttccggagggggctctgagagaatctagcctcccctctgtcctattggagcaaagattggagtgagtgttgccaccaacaggattttatcgtttgactccaatacctgaaattctgacttctctcctgtgcttcaatgagaatgataaattatcctagcaaaggggcctctggagaccatcttgttccagcctctgaagacagttgaggagatcaagcccagcaatggtggcagaatcttactccacagacttcagcagactagtcatttcaatacccaaagaaagacaagtgacaggggcaatggatctcaggctctgagataagtatatcagatgacactggtggctctaaggatattgcaattaagcagctacctgtagccaggtattctgctgctcttggccttttcccacgcatcgtctcgtgtcttctccgaaagaccttggaagataggcctggaagagactgttgatgccactttgaagaaaagaacactgagaactagaggagggaacactttgcccaagattactcacaaagccaagacccagagtccagcttagagaatagagttgttcaggctgccaattgcaagctcattcctctacctcatacttcctctgaggattttgacaaaatggattaattgggtgagccttggagacatgtgggaaacacctgcagacacaaaatgagtagtcatcctgtctccctttcaatagggatctgaacaggtgttttgatacttgaaagatgtgcatgtcaagtgagggtttctttctgcgatgttcaactggaactctcccatcagtagttacaattagaaatacctactgatggttagtctgaaggccattctcatggtcacctatacagtgtgtttccctgtgagctagcagacacaatgaccaggaaaaaacctatgaattccattcttaggtttcccagccaattgctcccttctgctttagaagtgactaggtactgagagtacaaacactcccactttataatgaaggcgtcatgtcaccccttcctttacaggtcctggggtccaggagacccagaatgaaggtgtcagttgggcatgaagtgttatttagtgtccattcttgatccttctgagcacctacagctggaaactaagcagatactggtcctgcattctgactgagattgtgtcttctttatgaggatagatcaaattggcagtcaggcccatgatagtcagtgcagttggggcagttgtagactttgctacaggatttcagggtttccaatcaccccacaggtaagtgaatgccaaagtcttcttttttcagaccatacaagaagtcattttgattttcaaagaagccgttttgattttcaaagaagcaggttctggtgacattattttcttccttggacaaagtggggggaaatttctaagtattttaactgagttcagggtccttagtgagcctggacagagcaaggagagggctccccactccctaagccccacagccagctctgcatcaccacacacagccagagcctgtgaggagctgccttcttccccatgtgacttgcaaagagtctcaggcaagaaaccagggcttcaaactgctagttcccatggagggtagttccctcgtgtggagcacttgtgttaggatcactgattatctgacaaaggctggtgcagaaaaaaaattgtaggcccaagtgtcaagaaccacaccagattggagatagaaaagaatagctgaaattatgtcagtagtgaaatgtcactccattgacccaccgaaaaaagaaaagaaatctgtttctaccaaacatttccagaaacgtatttatagcatgaagaaacacacatgggtagtgtgacctgtttggatgtgattacttaaaaatggaatgctctgaataggcactctctacattaaaggtatggaaggcgataggggtcagaattttaaaaatttaattttgaaaaaggtgactcacccctcatttccagagtgtaggcaattatgtcctgctttgataaaactgctagaggatggctatgcaaaagcataacgattcaaggaaacaaagtacaggtagtttttgagctgacagcagcaaaggcaccataagtcaaaatattggttttggtggagatgatcgatgtgtgtgtgtgagagagagctatgtttctaaccaagggcctaatgtttgttacagaaatgatcccagagacctacaagatgtgggaatcagcataacagggcaatgcagcaattaaccccacatcgttttctgtagttcctttttgtttcattttcttctgtctcacctcgttagaaaattcctcccagtcaggggtcgtccagtgcaggacgggggacccaagggtctcaagcctgcaagtccagaaggtgacaaacccaggagcactgggagttaagctttccttggggagggaagagccttgatgtccagcacacagcctggctataaagacacgaagcgacctacccactgtacagtccacttcacaggatcagctgaatcatgacctttaaaagttccgagttgaaactgaaggctctcctcagacctggctttttcctcagtccctgttcataccatctctgcacccacaatcacactgatttttcaaattcattttgtttttgctgtttcatttctggcattaataaaagtcttataagga

SEQ ID NO: 138754 - DNA, 2028 bp, Homo sapiens
  Payload ID: 7180
  Gene Symbol: GAB3
  Gene Name: GRB2-associated binding protein 3
  Uniprot ID: Q8WWW8
  ENST ID: ENST00000424127
  CDS Start-End: 53-1816
cttctgccgcgggcggctggcccagctggaggaagcggcggcggcggccacgatgagtgcgggcgacgcagtgtgcaccggctggctcgttaagtcgccccccgagaggaagctacagcgctacgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcagcagattccatggagagcctctcttacacgccctcctccctgcagccatcctctgccagctcccttcttaccgcccatgctgccagctcctctttgccaagagatgacccaaacactaatgccgtagccactgaggaaaccagaagtgagtcagagcttctcttccttccagattatctggttttgtccaactgcgagactggaagactgcaccataccagtctacccaccagatgtgatagctggtcaaactcagaccgttcattggaacaggcttcatttgatgatgtttttgttgactgcctgcagccgctcccctccagtcatttggtccacccctcatgccatggcagtggagctcaggaggtgccatcctcgaggcctcaggctgccctgatctggagtagagaaatcaatgggccacccagggaccacttgtcttcttcaccattgctggaaagttccttaagttccaccattcaggtagataaaaatcaaggttccttaccctgtggagcaaaagaactagacattatgtccaacactccacctccccgcccccctaagccaagccatctgtctgaacggcgccaagaggagtggagtacacacagtggtagcaagaagccagaatgcactctggttccaagaagaatctccctctctggtttagacaacatgagaacctggaaagctgatgtagaaggccaatccttaagacaccgagacaagcggcttagtttgaatttgccatgcaggttctccccgatgtaccccacagcttcagccagtatcgaagacagctatgtgcccatgagcccccaggctggtgcctctggtcttggaccccactgcagccctgatgactacattccaatgaactcaggaagcatctcaagcccgttgcctgagctgcctgcaaacctggaacctcccccagtgaatagagatctcaagcctcagaggaaatcacggccacctcctctggacctgagaaacctctcgatcatccgggaacatgcatctcttaccaggacccgcactgtgccttgcagtcgaaccagctttctctctccagaaagaaatggtattaattctgcaagattttttgctaatcctgtttccagagaagacgaagaaagctacatcgaaatggaggagcaccgaacagccagttccctgagcagtggtgcccttacgtggacaaagaaattcagcctagattatttggccctggacttcaattcagcatcaccagcccccatgcagcagaaacttctcctttcagaagaacaaagagtagactatgtccaagtggatgagcagaagacacaggctctccagagcacaaaacaggagtggacggatgaaaggcaatccaaagtatgagaggtgcgggcttgtgccatgtgtgaaacagggaagcttggggctcagtttgagttttttcttttttttttttttttgtccactaaaaacacactgatggtcaacacaggtcaaaaccaagagagaatgtgtagttttcaaggtcttggccagaacctttaggaaagaagacctgtttatacattgaaggaagaaaagaaggaagcagttgc

SEQ ID NO: 138755 - DNA, 450 bp, Homo sapiens
  Payload ID: 7180
  Gene Symbol: GAB3
  Gene Name: GRB2-associated binding protein 3
  ENST ID: ENST00000454973
  CDS Start-End: 1-450
cagtggtgcccttacgtggacaaagaaattcagcctagattatttggccctggacttcaattcagcatcaccagcccccatgcagcaggccagagcctttgtgttccaggtcatctccagtccagggccgaggcaagagaagcagcccccatctgaagtgtgctggcctcctggcagaggaaaaagagagattgcagaatcacagaatacctctttctccttaggattggaacatgtcacttcctttttgttattattgttttgttttcttgagtcaagatctcactctgtcactcaggctggagtgcagtggcatggtcatagctcactgcagcctcgatctcctgggctaaagttatcctcccatctcagcctcccaagtagctggtactacagttgcacatcatcacccacggctgttttttattttttaataaaaaatgatcttga

SEQ ID NO: 138756 - DNA, 2630 bp, Homo sapiens
  Payload ID: 7181
  Gene Symbol: GAB4
  Gene Name: GRB2-associated binding protein family, member 4
  Uniprot ID: Q2WGN9
  ENST ID: ENST00000400588
  CDS Start-End: 109-1833
gctttctaccccgcagtcccagggtatcgcaagccgtccctcacaccccacctccagcaacgccctctcgccctgtctcccccaccttcactgtgagctgcagcccccatgtccctgccgtccccctcaccctcccgggagctgtgcccacctgacccggcatttgcgcctttgtcttcgtggcccggaagtggccccgccggcggaagcacgagaagtggccacgtgctgtacagcggctggctgaggaagtcgccccccgagaagaagctgaggctctttgcctggaggaaacgctggtttatcctgcggaggggccagactagcagtgacccagatgttctggaatactacaagaatgatggctccaagaagcccctgcgcaccatcaacctgaacctctgtgagcagctggatgttgatgtgactctgaacttcaacaagaaggagattcagaagggctatatgtttgacatcaagaccagtgagcgtaccttttacctggtggctgagaccagggaggacatgaatgagtgggtccagagcatctgtcagatctgtggcttcaggcaggaggaaagcacaggcttcctgggaaacatttcctcagccagtcacggcctctgctcttctccagctgagcccagctgctcccatcagcacctcccccaagaacaagaacccacatctgagcccccggtgtctcactgtgtgccgcccacctggcccatccctgcacctccggggtgtctccgctcgcaccagcacgccagccagagagcagaacatgcaaggagtgccagcttctcccagggttctgaggccccattcatcatgaggagaaacacagccatgcaaaatcttgcccagcacagtggatacagtgttgatggggtcagcggtcacatccatggcttccatagcctttccaagcccagccagcacaatgcagaattcagaggcagcacccacagaatcccctggagcctggcctcccatggccacaccagaggcagcctcacaggctctgaggcggataatgaggcttcctccggcaagtacacccagcatggtggagggaatgccagccggcctgctgagtccatgcatgagggagtctgttctttcctgccaggaagaacgcttgtgggcctgtcagacagcattgcttctgagggcagctgtgtgcccatgaacccaggctcccctaccctgccggctgtgaagcaagcaggcgatgattcccagggtgtctgcatccctgtgggctcatgtcttgttcgctttgacctgcttggctccccactcacagagctttctatgcaccaagacctcagccagggacatgaggtccagctgccccctgtcaaccgcagcctcaagcctaaccagaaggccaacccaacaccgcccaacctgagaaacaacagggtcatcaatgagctctccttcaagccacctgtcacagagccctggtctgggaccagccacacctttgactccagctcctcccaacaccccatctccacgcagagcatcaccaacacagactcagaagacagtggagagaggtatcttttcccgaacccggcatctgcatttcctgtttccggtggcaccagcagttcagccccgccgaggagcactggtaacatccactacgcggccctggacttccagccgagcaagccatccataggctctgtcacgtccggcaagaaggtggactatgtccaggtggatctggagaagacccaggccctgcagaagaccatgcatgaacagatgtgcctgcggcagtcctcagagcctcccaggggcgccaagctgtgactcgggccaccaaaaccagagtggggccaggacagtgcctcagagctgctccgccacactctaaagctctgtaatatcagggaccgcatcccttacatagagagcagaggcctgatcaatatacatcctttgcctgcttggggcccacctgtgcctttggctggccatggtccccaccttcacccccttgctaggagcagttgccagcaagcatcctcagtctcttcctgcccctcagacccgggctcccaacagatttccactctcacacttactcatggtcctcagcctcttccttctagcctctgggctgtttccctcaatcctggaacatgaggagctaccttgctgacccggggacccaaggcccacaggccacagtggacatggaccttttcagccctggcattttttggtcaggggagaggcaaggccatcaaacgttggaatagttgagaaggaaggttaaaggtggtcttgagaagcaaaggaattagatccttagaccagcagggcagctgatacctgcaagggctcccactttcagactgaggccagagtatggcagctgctcccgggtgggagaggcagagagggaagggcaaaaggaagggaaaacatgaagacgaacagccgaaagccacaagaagcagggctggagctccagagactggggtgacaaggaccagggtcagggccccagaaatccggagctgcaggctggctctgctgctctttgctgatgccccttggggggcccttgcctgcctaagaaggcttgatctgagctgggcaaa

SEQ ID NO: 138757 - DNA, 2698 bp, Homo sapiens
  Payload ID: 7181
  Gene Symbol: GAB4
  Gene Name: GRB2-associated binding protein family, member 4
  ENST ID: ENST00000465611
  CDS Start-End: 1-575
acgtgctgtacagcggctggctgaggaagtcgccccccgagaagaagctgaggctctttgcctggaggaaacgctggtttatcctgcggaggggccagactagcagtgacccagatgttctggaatactacaagaatgatggctccaagaagcccctgcgcaccatcaacctgaacctctgtgagcagctggatgttgatgtgactctgaacttcaacaagaaggagattcagaagggctatatgtttgacatcaagaccagtgagcgtaccttttacctggtggctgagaccagggaggacatgaatgagtgggtccagagcatctgtcagatctgtggcttcaggcaggaggaaagcacagctgagcccagctgctcccatcagcacctcccccaagaacaagaacccacatctgagcccccggtgtctcactgtgtgccgcccacctggcccatccctgcacctccggggtgtctccgctcgcaccagcacgccagccagagagcagaacatgcaagcttcctccggcaagtacacccagcatggtggagggaatgccagccggcctgctgagtccatgcatgagggagtctgttctttcctgggccaagacatctgatgtgatccttgccttgatcagggcctgagatgctgacctgccagtgccgagtcaggacttgaggtggatgatgggtctcgaggccacatctgcatggtgcatggtctgtgctgccttctgcctgggtctggtatccagaaacctgagtggacattgggtgctgagccacatctgcatggtgcatggcctgtgctgccttctgcctggctccggcatccggaaacccacgtggacattgggtgctgagccacacctgcatggtgcacggcctgtgctgccttctgcctgggcccagcatccagaaacctgagtggacccagccactaaagatattttatcccatagatttgtcacaaattgtagttggaccccaaggggtcctgagagctagaagtgcccagacatctcatttttttcttgcctctactttgatttcagagtctttccaaggtcactctgatagcttcaaagtgtagccctccccatgtagtgaactcttataattgtatgctgccttggcatccacatcgaatggagttttaactttctcagaccagaggcagaggacttagtctccctgatggtttccagttctacaccacacccatgtggcttcagtcagtggccagagatgggaatttagacttacctcccccatgcagcagactgggctcgccactttcttgctgctccctttaaatggaccatccaggcatttactctgaccttaattaagtgatcccacaccccattctgcaagatacacttccagttgccaccctctctcctcttactccctaacctcccaggacctgtaagaactgaaaactcttccacttttacatgttgactgtgtcatggaagctgctccaaagtctgacccctgaggctgcccagaggggccccatccatggggttcctggctggggcacttctatctgggccgcaggtggctgctgaagacagcagcccccagccaaggtgatcaaaagtttcgttcaaaacaccccgtcatgactctttttggccttgtctagaaattctcattcctatcttgttcttgctggtgatagctgtgtttctttcactgtcctcttcctagccaggaagaacgcttgtgggcctgtcagacagcattgcttctgagggcagctgtgtgcccatgaacccaggctcccctaccctgccggctgtgaagcaagcaggcgatgattcccagggtgtctgcatccctgtgggctcatgtcttgttcgctttgacctgcttggctccccactcacagagctttctatgcaccaagacctcagccagggacatgaggtccagctgccccctgtcaaccgcagcctcaagcctaaccagaaggccaacccaacaccgcccaacctgagaaacaacagggtcatcaatgagctctccttcaagccacctgtcacagagccctggtctgggaccagccacacctttgactccagctcctcccaacaccccatctccacgcagagcatcaccaacacagactcagaagacagtggagagaggtatcttttcccgaacccggcatctgcatttcctgtttccggtggcaccagcagttcagccccgccgaggagcactggtaacatccactacgcggccctggacttccagccgagcaagccatccataggctctgtcacgtccggcaagaaggtggactatgtccaggtggatctggagaagacccaggccctgcagaagaccatgcatgaacagatgtgcctgcggcagtcctcagagcctcccaggggcgccaagctgtgactcgggccaccaaaaccagagtggggccaggacagtgcctcagagctgctccgccacactctaaagctctgtaatatcagggaccgcatcccttacatagagagcagaggcctgatcaatatacatcctttgcctgcttggggcccacctgtgcctttggctggccatggtccccaccttcacccccttgctaggagcagttgccagcaagcatcctcagtctcttcctgcccctcagacccgggctcccaacagatttccactctcacactt

SEQ ID NO: 138758 - DNA, 2119 bp, Homo sapiens
  Payload ID: 7182
  Gene Symbol: GAPT
  Gene Name: GRB2-binding adaptor protein, transmembrane
  Uniprot ID: Q8N292
  ENST ID: ENST00000318469
  CDS Start-End: 298-771
ttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccat

SEQ ID NO: 138759 - DNA, 3016 bp, Homo sapiens
  Payload ID: 7182
  Gene Symbol: GAPT
  Gene Name: GRB2-binding adaptor protein, transmembrane
  Uniprot ID: Q8N292
  ENST ID: ENST00000396776
  CDS Start-End: 463-936
aaggaagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaaaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccatacaaggaatatttgttgtgtcttctatctacttgctattgtgctgtgcacctgagggacatgggttggtggaggggttacaaaattaaaaagagagacatggatcctgaacacatacagtctagtaggaaagaaaacatagtaaacaaatgaatacgatgctgctcatgaagctatgatagctcatctctaaatccactcttttatttgctcctctgaattgcttgacctgggcctctgcaaacatttcttttgccaggtggatccattctattctctaccaatagggggcactaaggaagaccgaaaggcagtaggaggcaacagggaattgctcctgcctattctttctgttgcccccgcaggaatttattgccatgtggtttactccagcatcactggttgtttgcagctttctagtttcttccatcattcccaggaccagcttctctgcaacctgtcagaagcaccagcaccagccaggtggcaccctcccttagactctgacagccagactctccttcaacctcctgaagtggtgcaggagacaagtggtaccctcagagttctgcgtcccagcctggcagggctcctcctctgaggtctggtaactctcagccaagattgttacagttactatctctgtggtacctgtgtccccttttttgtttttccatcctgccaatgcctgtttagccaattatctatattaaattctctctgttaaaacaaa

SEQ ID NO: 138760 - DNA, 769 bp, Homo sapiens
  Payload ID: 7182
  Gene Symbol: GAPT
  Gene Name: GRB2-binding adaptor protein, transmembrane
  ENST ID: ENST00000511930
  CDS Start-End: 563-769
ggaagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaacaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggctta

SEQ ID NO: 138761 - DNA, 731 bp, Homo sapiens
  Payload ID: 7182
  Gene Symbol: GAPT
  Gene Name: GRB2-binding adaptor protein, transmembrane
  ENST ID: ENST00000502276
  CDS Start-End: 526-731
aaggaagtaacccaccaaagtgaaaaagaggaacaagttctaacccaatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggctt

SEQ ID NO: 138762 - DNA, 2651 bp, Homo sapiens
  Payload ID: 7183
  Gene Symbol: GRAP
  Gene Name: GRB2-related adaptor protein
  Uniprot ID: Q13588
  ENST ID: ENST00000284154
  CDS Start-End: 712-1365
accttctgagctggtctttgatggatgaataggagtctcctgggagcagaaagaggagaacaccaggcagaggaaccacgtgtgcaaaagtctggggttgaaatgagagtttggtgtggccccttgctgtggctgaagccctgggtttgtttagagtgaaggggatgacaaaggatgagaatgggggctgtttgtaggggcaggtggaggtggtggattgcaagggccttgaatgccaggtgaggagcttgggattgaaggagcaggaggcagggcatcacaagaggcatcagggtttaggaaaagatggagagtcattggcagattggtgaagggaggccagcatctggtgccatgagactcagtgcctgagccagcaggacagctttggcacttctcctccaggcacctcacttttacggatgataaaacatgggcacaagggggccccactcccagagcttcagggagactccccaagggccattcctggcacctggggtctgaggtagggacagagctggctcacaagccctccctgctctgtgacatgtctgtttcctgtttctcccccatcaggagcagtttcagtctcaacttcaaaagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgacttcagctccacctggggcacccagcaccccaccacagggctagaggccctaagaccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaa

SEQ ID NO: 138763 - DNA, 834 bp, Homo sapiens
  Payload ID: 7183
  Gene Symbol: GRAP
  Gene Name: GRB2-related adaptor protein
  ENST ID: ENST00000395635
  CDS Start-End: 172-738
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacgggg

SEQ ID NO: 138764 - DNA, 846 bp, Homo sapiens
  Payload ID: 7183
  Gene Symbol: GRAP
  Gene Name: GRB2-related adaptor protein
  ENST ID: ENST00000573099
  CDS Start-End: 72-689
ctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaatcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcc

SEQ ID NO: 138765 - DNA, 776 bp, Homo sapiens
  Payload ID: 7183
  Gene Symbol: GRAP
  Gene Name: GRB2-related adaptor protein
  ENST ID: ENST00000583020
  CDS Start-End: 35-346
tctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaaatgggcaaactgaggccagagaggggccatgcctgatggagatcgcccagcgggcagttagcacccagctatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctg

SEQ ID NO: 138766 - DNA, 3893 bp, Homo sapiens
  Payload ID: 7184
  Gene Symbol: GRAP2
  Gene Name: GRB2-related adaptor protein 2
  Uniprot ID: O75791
  ENST ID: ENST00000344138
  CDS Start-End: 264-1256
acagactgcagggctgactagggttagtttggaggagggagtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggccttcagctgtcactgcttcctccttgtcttgggaattttcacggagaacagctaagcagagaccacacctcggcactggacacagaacaacagggtggggttgaacttggtggggcacgttctagctgacctgcaagccccgctcacctggagggcttgcagagcagctctcctcctgttctccaaggggtgggcactgttgcattaggaattaaggtgcagcccagtgctgcgggcagccaagcgagtctgagcggggatgtgaaggcaggacggggttggagagaccctgcctgtgcaaggctggcctcctagtcaacacctagctgagacattcatctctgttcaaattaatattccttgggtctttcaaatgaatgtttcaatgtgaggagcgaagtactgggaaatcgagggattttccacaatccccaagcagcttactcagtggaacctctgtttccccagctatgaaggaaatagcatcctacattccgtaaagtgcttgaagaagctctagctgagaatgctgaattttacagtcattgttttatggttacaagggtatgtcttcagggctctgttcattttccctcttgattttctcttttgaagatgccttgcccagtggcatggaaagaagcccacttgatgataggagcctgactatgaattgattgactaaacatgaccccaggtggaagctggctttgacaccagcttcctgttcagtctgaccactgctgtcctcctgctgcccaagagttgcacctggagcaaggaaccccaccatggctgtcgctctccatcccatcacgctagaatcatgtgtccaagggctcactctggaggtgcacagcacaggtcagcctggccaggggcgaaggagacagtagagaggaagctcagggccttaggggaggccgggtgcaaacccgttctgcaccaagtgcactcggagtttgtgggtatgggtgtgtacccctgcaggtgtgcacatgtgtgcttgcacgcacatatttgtgcactcctgtgtgtatacatgtgtgcttgtgtatgcatatgtgtgcattcctgcatgtgtggacatgtgcgtgcatgcatctgtgtgtctgtgtgtgtgctgagacaggaaagggggtgaaagtgttggtgagggagcctggaagttttctcttccccaacctctcttgctctaaggagggatggggttgggggcagccgttattgaaggtgatcggagaagaaagattttctgactcagaagtgactgccagtgtagcacaagcagtgtcccttgtgactgtgattctacagttctctgatcctcatgtttcctttagaggaaagaggaaaaaaggaactctgtggtgggtattgggagggaaaagaaaatagcctggtggaggcaggagggagtcgagtgtgagtaaggagcacctgcagcttttggaagtgaaagcagagagagggaaaggtagctaagacatccaggaggatcaaggggcagcgtgagaggcacagggggaggaaagggagagggtgagtggggccagggaagagaacggtgtggagttggtgggcagatggtgcaggaggagggctgggcagtggggagaggaagaatcagagcagagaaaccgctgctgcggaaggcagggagcaaagaagcataaggaaaagaacaggagaaagaacaaaggcagagaagacctcctcagctattttggtgctaggtaatgtgaaatgctgcagtaaataaaagccataagtaatgtttgattttacagtatttacaaaccatatgctttaaacagcccacaaactccatccagttgtctgatgatgtgggaggaccagctctagttagacggaggtatgtgattcgattctggtggagactttgtgccttgaaaggcttctcaggaaagcagtaataaaacaaagtgtccttgtttggccaggccgtgtctggtgtctgcgttgcatacccctcaggtagagagtgagaacgagaccagggggtgacaggggtcatcggcctgcaggagctgaccccgtaggcaggcggtatgagcagagctttcagaacccctggagctcggtgttctgttgtagcaaaagctactgaagagtattttgtactgagatgccaaagcatctttcccttgctcatcagcctccattcagaaggaagcgggaaagtcacccaaaccacctacaaggaatgagggctcttagcggccaggtaaagaggacaagaaccaaactgtccacattatggaggggagggggaaagagagctcaacccccctcagcctctggtgctgccagggggagc

SEQ ID NO: 138767 - DNA, 1304 bp, Homo sapiens
  Payload ID: 7184
  Gene Symbol: GRAP2
  Gene Name: GRB2-related adaptor protein 2
  Uniprot ID: O75791
  ENST ID: ENST00000407075
  CDS Start-End: 291-1283
gatgatgaaaggagaagggaaaggctgcggatggccttcatttcctgctcctggcatctggggattccgagaatgatcccaggacctagatcctatagattccggcagctcttcctgcaaacacaagcccttgttgtgtgcctgagccttgctctccggcctggagacatccatctgcccactctcctaggaactgctgattaccaggaagcaccatcggctctgctgccctccccctggcagagaggcacaatgaccacattatttctcttccagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagct

SEQ ID NO: 138768 - DNA, 568 bp, Homo sapiens
  Payload ID: 7184
  Gene Symbol: GRAP2
  Gene Name: GRB2-related adaptor protein 2
  ENST ID: ENST00000420971
  CDS Start-End: 278-568
aaaagtcataaaagcattctatgctggaccggttcgtgttaagtctgagttcctcaatcgctggctctcaggagctgtttggaaaattcgttgccatgcatgagtcgggggattggttttttttccactggaaattgttaatggggactgcattagcggccccttatcgctttgcctgatagagagacagcaggttcgcccaaacaattctggaaccctgatcactgccaattaggggagtattgtctggctgacataatcaacttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcagg

SEQ ID NO: 138769 - DNA, 1308 bp, Homo sapiens
  Payload ID: 7185
  Gene Symbol: GRAPL
  Gene Name: GRB2-related adaptor protein-like
  Uniprot ID: Q8TC17
  ENST ID: ENST00000344415
  CDS Start-End: 152-508
cctgtttctcccccatcaggagcagtttcagtctcaacttcaaaagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaataacagagcccagaggggtccctgcctgggcccaaaatcacacagcagattggggtagagccggagaggacccgagactcctgtgccagcctgggcatcccctccactgccagggaaggactgcatccaagtcgcatccgtacccaggccgaggtgtccgaggcccaggctgaaatccggttgctgctgcagagaccaagtttccaaggccttgtcaagtgggctgtgccagacgatccccaggcctgtcattggctgctcttcggctcggacacaccaaacctcaccaagcacttccatttctgagggaatagaggttgtggcttccgtcaagcacccatttaccccaccctcctcctcctcttcctgcaaacttgagtcacagctgccctgctgggctcaggccccagggatgtctgagtcagcctggctggggttccagtcctgacaccgcccttaccagctgggagactccgggaacctccaaccctgctgagcctccacttcgacatccgtgaaacagccatgaataagcaggtctcaaaggtcgactcctgtatgcagggacacagcatgcagtaggtgcccaatcataacagcagcacccacctggagccccttatagcagcccttctcctctgcacttccacatggcatctcatttaaccttcaccacaacccaactaggaaggcaccatcattatcccattttactgatgaagaaactgaggcccaggaaggtgaatttaccagccagctcacaaatggactagtagatggcagtttgtggattggagcccagaggctgtgctcctgcccacaccctctcaaatgagggctataaaataacactctaag

SEQ ID NO: 138770 - DNA, 820 bp, Homo sapiens
  Payload ID: 7185
  Gene Symbol: GRAPL
  Gene Name: GRB2-related adaptor protein-like
  ENST ID: ENST00000574324
  CDS Start-End: 1-196
catccgcgtcaagccccatccgtggtactcgggcaggatttcccggcagctggccgaagagattctgatgaagcggaaccatctgggagccttcctgatccgggagagtgagagctccccaggggagttctctgtgtctgtgaaagcccagaggggtccctgcctgggcccaaaatcacacagcagattggggtagagccggagaggacccgagactcctgtgccagcctgggcatcccctccactgccagggaaggactgcatccaagtcgcatccgtacccaggccgaggtgtccgaggcccaggctgaaatccggttgctgctgcagagaccaagtttccaaggccttgtcaagtgggctgtgccagacgatccccaggcctgtcattggctgctcttcggctcggacacaccaaacctcaccaagcacttccatttctgagggaatagaggttgtggcttccgtcaagcacccatttaccccaccctcctcctcctcttcctgcaaacttgagtcacagctgccctgctgggctcaggccccagggatgtctgagtcagcctggctggggttccagtcctgacaccgcccttaccagctgggagactccgggaacctccaaccctgctgagcctccacttcgacatccgtgaaacagccatgaataagcaggtctcaaaggtcgactcctgtatgcagggacacagcatgcagtaggtgcccaatcataacagcagcacccacctggagccccttatagcagcccttctcctctgcacttccacatggcatctcatttaaccttcaccacaaccca

SEQ ID NO: 138771 - DNA, 573 bp, Homo sapiens
  Payload ID: 7185
  Gene Symbol: GRAPL
  Gene Name: GRB2-related adaptor protein-like
  ENST ID: ENST00000583540
  CDS Start-End: 1-53
agagtgagagctccccaggggagttctctgtgtctgtgaaatgggcaaactgaggccagagaggggccatgcctgatggagatcgcccagcgggcagttagcacccagtaacagagcccagaggggtccctgcctgggcccaaaatcacacagcagattggggtagagccggagaggacccgagactcctgtgccagcctgggcatcccctccactgccagggaaggactgcatccaagtcgcatccgtacccaggccgaggtgtccgaggcccaggctgaaatccggttgctgctgcagagaccaagtttccaaggccttgtcaagtgggctgtgccagacgatccccaggcctgtcattggctgctcttcggctcggacacaccaaacctcaccaagcacttccatttctgagggaatagaggttgtggcttccgtcaagcacccatttaccccaccctcctcctcctcttcctgcaaacttgagtcacagctgccctgctgggctcaggccccagggatgtctgagtcagcctggctggggttccagtcctgacaccgcccttaccagct

SEQ ID NO: 138772 - DNA, 391 bp, Homo sapiens
  Payload ID: 7185
  Gene Symbol: GRAPL
  Gene Name: GRB2-related adaptor protein-like
  ENST ID: ENST00000437957
  CDS Start-End: 180-391
accagtctgtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaa

SEQ ID NO: 138773 - DNA, 866 bp, Homo sapiens
  Payload ID: 7185
  Gene Symbol: GRAPL
  Gene Name: GRB2-related adaptor protein-like
  ENST ID: ENST00000577213
  CDS Start-End: 86-388
aaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaagtgagctctggcccttgggggtgtgtgcagaggagggtgggcggggttgggcagcatttgagctgagccttggggcccgggacgggctcacggagtgagggtggaggaatggcatccctgcagagggagcagtccgggcagaggccttccggacacaggcggtggtctgggcaccccagggtgcagcccagagcagtggggtgtgttgggaaagcaggatcaggccagctgtgcaaggcctcaatgccaggctgaaggtccaggcttctacgagtataggagccatcataggttcttcatcaggagagggcgatgtccagggtggtgatgtggcaagagattgagggcaggagagtgctgaaacgcccagggcgggtgtccaggatgtgctccgcacagggtcccactctatgtgatatagttgggaagatgcaccctgaggccaggctgcctgggctcaaatgctagttctgccacttcct

SEQ ID NO: 138774 - DNA, 4138 bp, Homo sapiens
  Payload ID: 7186
  Gene Symbol: GREM1
  Gene Name: gremlin 1, DAN family BMP antagonist
  Uniprot ID: O60565
  ENST ID: ENST00000300177
  CDS Start-End: 160-714
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaaccgcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtg

SEQ ID NO: 138775 - DNA, 4015 bp, Homo sapiens
  Payload ID: 7186
  Gene Symbol: GREM1
  Gene Name: gremlin 1, DAN family BMP antagonist
  Uniprot ID: O60565
  ENST ID: ENST00000322805
  CDS Start-End: 160-591
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaaccgcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtg

SEQ ID NO: 138776 - DNA, 2648 bp, Homo sapiens
  Payload ID: 7186
  Gene Symbol: GREM1
  Gene Name: gremlin 1, DAN family BMP antagonist
  Uniprot ID: O60565
  ENST ID: ENST00000560830
  CDS Start-End: 160-591
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagag

SEQ ID NO: 138777 - DNA, 623 bp, Homo sapiens
  Payload ID: 7186
  Gene Symbol: GREM1
  Gene Name: gremlin 1, DAN family BMP antagonist
  ENST ID: ENST00000560677
  CDS Start-End: 160-288
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatcccccctccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtccta

SEQ ID NO: 138778 - DNA, 14606 bp, Homo sapiens
  Payload ID: 7186
  Gene Symbol: GREM1
  Gene Name: gremlin 1, DAN family BMP antagonist
  Uniprot ID: O60565
  ENST ID: ENST00000622074
  CDS Start-End: 190-744
atttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtaggacacttcaggttgtggcaagggagagctggtctgcaatcggaagtaccagcctcttccctagagcacaactagaaagaagaactatagagtgttataagggaggccctgagatggaaggaccatcacacagaaatgataatatcttcatttcagggtgttccaggggaaaagcaggagaaagatttggggctcagtagaaggaaaagcttcctagtggtaagagtgattggcaataccatgaggtacctttaaaagatagtgaactcctgtccttggaaatattaaaccacaggctagatatcatttaatagggatgtgaagtagagtaagtcactgcccttggtgtgcaattgtgaacttgtcaatttctgaggtccctttctacttagatatataatacaagatttctattaggtatgggtgctctgatgataatgaaaatcccagcagctatgtatgggatggttacaccagacactgtgctaaggattttctttgaattgtttctcactcaatcttcacggtagctcagtgaggtaggtaccattatcactgctagaaagcagtgaacttatatggtcttactgtggcactgggtccttaaacattatgcaaaactgtgagcaacttttatcggtttgttcttttaagaacataacacagcactctaaaaatagatctaactagattgttcacatctagcgattaaggccaccctgagattatagctgcatcatcaggaacccaagatctgaagcattcagtcaaagcctcttggccacctctctttttgtcatggccttcttggacttggagggggagaatggaagcaagtaccaaggagaaagtgttctcagaaaagccacacccattagaaaaatacaaggcctgaaaggtgtgagtgggacttgacacggaagagcatttcaagcttaagaaaaaaaaaaaaaagaagaatgtgggaggatgtcagcaacaatgcttgagattccctggtcccccaaagagtctctcctccataaaactaatgagaatgtgacaaaaatagattcaacttcttatagctctggaaattaactgaagatgtatagcaatttgcagagcatttattcaagaaaaagactaaatctctgtgagcactgtgatattgtaacttgcactactctcatctccccctctccagctccacaatagctttgaaaccaacagcctgcaattaccatgaaaatcagcagtctggcagccactgaaggtgacagaatggagttggagttctttcaaagtcccattcctagacaattgtcactatttgacctgtttggcaggccctggaagctccacttgcaaggctatatttgacctgactggaagcttcccagggtaaaaaactttgtcaaaacaactagaggcaattgattctctttgtggctgcctggggtaatgtataacagttggggaaagcaattggctaaataaaaagcctaaaaggagaagctggaaaaagagattttcatagggactttgaaaagctccaaagtgttattggcaatctagactgccaaatgcataaataggactccatccatgcccaggactgtgcagatgctcaggaaaaacccaagaaagccttaagctctcacttcaagctgatcttgaggctctgcacaagccataagtaaagggaatgcagagttgtcaattgcatggcggagtgttgagtgtgcctcagcattcacacagagctccttggcagagactggttgaattattgattccaagtgtttgaggaaatccgtgtacaactattagatgactactaaccaagcagagacttcagtgtccacacacaacaaaaaatacagactttacagaattagttcagaaaagtcattaaacaaagaaacaacaacaaaccctggggaaatgacagtacgatcaaaccatgcatggccctgcctgcatgtgggaatcctcatccaagtcatactttctaaacatcataaaaagcccaaaccagtctcctttcctggctctctcaagtcattttcagaccaggttaggagacgtgagctgctctccacaaaaagcctcatgtgagtaataaatgtttcatactctcttggggtgtgtgtaacatcatcagtctcagcatctaaaccaaattttggtgacatttcatcttgtttatgcagatgtccaccacacctataaataaacaaactactgaaactgattcaagaaaaaataaaaatctgaatagagctatcacaagtaaagagattaaataagcaatcaaataacttcccagaaagaaaagcccaatttaggatgtcttaactgattaatgttagcaaatatttaaagaagaattggtacaaattcttcacaaactcttccagaaatggaagaggaggaaacactttccaccttattttctataactagtattaccttgataccaaattctgacaaatacatcaaaaataaaaccatagaccaatatctcttttaagtgtaaatgcaaaaaaattcaacaaaatgctagataactgggtccaacaacatatggaaaggattatataccttgaccaagtgggatttgccccaggaatgcaagattgatttaaccatcagtgtaatgcatcatattaatagaataaagacagaaaccacacaatcatctcgatacacgcagaaaaatcatttggcaaaattcaacacccctttgtaataaaatcactcaacacactaggaagagaagggaacttcttcaacctcacacatggcatctatgaaaaacccacagctggccgggtatggtggctcaagcctgtaatcccagcactttgggaggctgagccaggcggatcacctgaggtcaggagttcgagaccaacctgaccaacatggagaaaccctgtatctactaaaaatacaaaaaattagcccggcgtggtggcaaatgcctgtaatcccagctgcttgggaggctgaggcaggagaatcggttgaacccaggaggtggaggttctggtgagccgagatcacgccattgtactccagcctgggcaacaagaacaaaactctgtctcaaaaaaaaaaaaaaaaagaaaagaaaaacccacagctaacatcatacttaaaggtgaaagactgaaagctttcccccaagaggaactaacaggatatctgctgtcactatttttattcaatattatactggaggttctacctagggtaattaggcaaaaaaaaaaaaaaaaaaaaaaaaaaaaaaaaaaaaaaaaaaaaaaaaaagaaaagaaaaaagtcatccagattggaaaagaaataaaatgatttcaattttaagatgacataatattgtatgtagaaatcctaaggaatttacaaaagaactattagagctaatacatgatttcagcaaggttgcaggatacaagatcaacatacagatataaattgtattctacacacttgtaatgaaaaatctgaaaataaaattaagaaaatagcaccctttgaatagtatcaaaaagaataaaatacatagaaaaaatgtaacaggaagtgcaagactggtacattgaaaacaataaaacattgttaaaaaatttaaaatcatcaaaatagatggaaataaaacctgtgttcatggatgaaaaaaattaacattgctctacagattcaatacaattcttatcaaaatcccaggtggcttaagaaattgacaagttaatcctaaaattcataagaaattgaaagggatccacaatagccaaaataatcttaaaaaagattttaaaaagttggagaactcacacttcctggtttcataacatacaccaggctgggcatggtggttcatgcccataatcccagcactttgggaagttgaggcagaaggatcacttgagcacaggagtttgagaccagcctggacgatatagtgagaccttgtctctactaaaaatttaaaaaggaattagccaggtgtggtaacatgcacctgttgtcccagctacttaggaggctgaggcatgaggatcacttgagcccagaagattgtaccactgcactccagcctacatgacagagtaagtctctgtctcaaaaacaaaacaaacaacaaaaatactgaaagctttccccatacaggaactaacaggatatctgctgtcactatttttattcaatattgttctggaggttctagctagggcaattaggcaaaaaaaggaaaaagaagtcatccagattagaaaagaaataaaataatttcaattttcagatgacataatattgtatgtagaaatcctaaggaatttacaaaagaactgctaccctgaaagaattgttgtaaggcaaatacccctgtaattaccattaggggaagaaatttttccatgcttcacagaaactctccttataccccacctcaattttaatctttttctgtaccactacagttataattctcctaaagcttaaagcaattacctccttgtttatatttatagtttcatcactgaagtgtgcattcctaaactcaacaccttagtctggttgcaaacagtttaaatgagaaaagataaggcctgaattaaggcagcagccctaaacctttttctataatcctgatagtgattaccacctaggggattataaatgtttgcttcttcctctggcaccaacaagtttactgagcagaagtttaaaataattggataatggggcaggtgacatcagcaagatgttgtattagcaaatgctggacccttcttcaatccacaaacacatctattctgcaaaaattcatggctaaattcctttgtgaggaatccagaaactaaaaggctcctgcactcccagcaaatgcaaaaaccagactcaccaaagctggtagagagatttgagataccaccttgtccgaatccctaaccccagcacagtgccatgtagtcagcaagagactccctagcactcagtttctcccaggtgagaggagttggttcacatatccaagacctccaacttttctgaggagattcccagaggactggcttctatcttgtcagtcttggagctctgacagaattggtactatctagctacctggggaaggacagagacagaggtttagaccagtagatgacatggcaccctgccctctactgcctcacctcctggctcagcacagacaggacaaaaatcatggctacctacatttccctggagaaggaatgatttgttaaaggcccccaaatcactgggcagacttattggtgggggtcttctcctctgaggcccagctgtgaggactgggacaggtgactgctttgtctaatgtgcagacaccaacacaaagagtcaaggaaaatgaataatcatacgaagatgttccaaaccaaagaacaagataaatctctggaaactgagctaatgaaataaacttatgtgatttacctgacagagaattcagaatagctctcataaagattctcaccagagtcaagagaacaatgcatgaaaaaagttaagaattttgacaaagagatagagtatatttaaaagtaccaaaaagaaatggaactgaagaacacaacaactgaactgaaaaaatttatgacaggacatcaacaggagacaagattaatcagaagaaagaatcaatgaacttgaagacaggtcattggaaataattcagttagaggagaaattaaaatgaaaaagagtgaaaaaaagcccaagggtcttatgggcaacatcaagctgaacaatatactcattattggcatcacagaataaaagagagaaaagaactgagaacgtattcaaagaaataatggctgaacacttcccaaatatgaggaagaaaatgaacattctgatccaagaagcccaaaggtcataaaaaagtgatcccaaagcctacaggcatattataagttgtcatcctagagaaagaaaaatatctttctcccagcctccatattcaaatcttaaggaaaattcttatggacttagcttgagtttcaagttcatttctaaaatcaatcatggtggccaaacggaatgagcattctgatttgccagtgtggtctcatgttacccctgtgcctagaaaggaaacaggagatgaaaagcatggtgataagaagactggatggcaccacatgggatagggggaaagtagttgaaaaaaaatagttgtaaggaaaagagatacaaggagtcaaaaataacaaatatctacttaaaagccttttccacatttaatgttttttgttcactgtggtgtagtaataaatgtctatacttaaggggtgaggattgatatatttaaagtgaatggtctggaaggcaaggaagctcattccaacagattcatgctacattgtttagtgacaaataaggggaacagaacagagaaagtgatttcagctataaatataggagataataaaatcctttagtaaacagtatctaagccttgtttttatgatattggggaacagtaacagatcaaagtactgtagtcttcagtatgcagacctttcactttcttagtttattccagggtcttttttttttttgctgctattacaaatagcattgttttcctaatttttgtttaagatagttcatcgttggtatagaaatgccattgatttttgtatgttgattttgtatcctccaactttactgaatttattagttctaacagttttttgatggagtctttagggttttctatgtataagattatgtcatctgcaaacagcaacaattttaccctttgttttcaacgtgagcgtcttttatttatttttcttgcctaattgctttagctaggacttccagcactaaattgaatagaagtgatgagagtgggcatgtatgccttgtttctggtcttaaagaaaaacatttcagttttccattattcggtataatgttagttatgggtttttaaaaatatatatgacctttattaggttgaggtacttttcctctattcttagtttattgaatgtttttctcatgaaagtgtgttaaattttgtcaaaaccttttttacatccatcaaatgattatgtaatttttatcctttattctgttaatggattatcacattaactaattttcatatcttgaagcatacttgcatcctaggaataaatcccactttgtcatagtctttgatccttttaatataatgttaaatttggtttgccagtattttgttgaggatttttgcatctatatattcatcaaggatattgggctgtaattttcttttcttgtggtgtctttgtccggctttagtataaaggtaattctggcttcataaaataagttagaaagtgttctctcttctttgatttttttggaagagtttgagaataattggcattagttttgttaaatgtttggttgaattcactagtgaaattatttggtcctgggattttctttactgggagttttttgattacttgttcaatctttacgctagtcataggtctgtccagtctttgtatttcttcatgatttagtcatcatgtattcatgggttgtaagacttaatattcttaaaatgcccatattacccaaagtgatctatagattcatgcaatccccatcaaaaatcccagtggcatttttatttacagaaatagaataattctaaaattcatctgaagccacaaaagacaatgaataaacaaatcaatcttgaaaaagaagaacaaagctggaggcattatacttcctgatttcaaaatatcctgcaaaggtacagtaatcaaaacagtatgttaccagcataaagacaaacacacagaccaatagaacagaatagagagctcagcaacaaatccgtgaatatacagtcaactgacatttggcaatggtgccaagcatactcagtgggagaaatgataatctcttcaacaaatggtgttgggaaaactgaatatccacatgcaaaagaataaaattggaccctatcttataccaaaaatcaactcaaaatggattatttaaatgtaagacttgaaacagtaaaactcctagaagtaaacagaagagaaagtttcatgacattgcccttggcaatgatttcatgtacataacaacaaaagcacaggtaataaaaacaaaaatagacaaatgggactacctcaaattaaaatgtttctgcacagcaaacgaccaactgaatgaaaaggcaatctatggaacagaagacacggggtgacatgagaccactttggcaaatcagaatgctcattccatttggccaccatgattggttttagaaatggacttgaagctcaaagaaagcccataatatattccttaagatttgaatatagaggctggaagaaagatttttttctttctctaggatgacaagttatatataataagcctgtaggccaatatctgctggcagccacctttcccaggtatatggatgaaactatctgaaggatgaagcctccattcacagaaaatcagagctgtaaagggaagaggatatcctgatgaatttttttcttggattgagccatgtctgaagtcaagccaacttttgaagtatcctatagtacttatatattgcttggtaacaaattatgccaaaatttagtagcttaaaacaacaaacatctattatctcatgcatttctgatatagatataggagtgactaatctgggtggttctgggtcagaatctctggtgagtgtgtaggcaaggtgtcagtagggggctgcaattatctaaaggcttgcctggggctggagacgcactttcaatgtggtgtactcacgtggctgttggttggaggccaaatgtgctaggcaaagcctcatgcacatttctctgtaaggaaacaaagctggcttacttgggggcaggatttttttttttcccagttgttcttcaaaatgaagtttcccgctccaagtcccagccagatatgtgaaaaacaatccttgcagaacaaccctattagcagttctgcaaggatttttaggaaccgtattagcaagttcctcagttcctcaccatgtgaacctctcttcacgacttagtaactggcttcctctagagtgactaatccaagagacagcaaggattgacagccatgacagcacagtgcctttcatgacttactctccaaagttacaaacctttacttttgctttatcttatttgttagagcaagtcactaaatttgcccacatctaagatgagggtatttgggcttcacctcttgaatggagaagcacccaaaaatctgtggcctttttttttaattacactctcagttacatgaatcaataaattccatttttggcttagcttctattgggtttctatcacttgcaaccaaagtgccctaaccagtatctacatctgagtcattaagaaagtttcagacagggctgggcgcggtggctcacacctgttaatcccagactttgggaggccgaggcaggcggatcacgtggtcaggagatcgagaccatcctggctaacacggtgaaaccttatctctactaaaaatacaaaaaattagccgggtgtggtggcaggtgcctgaagtcccagctactcgggaggctgaggcaggggaatggcgtgaacccgggagacggagcttgcagtgagccgagatcacgccactgcgctccagcctgggcgacagagtgagactcagcttcaaaaaaaaaaaaaaaaaagaaagtttcagatattattgtttattgcttttaatctagtgaattcataaatcgtcacttaactcaagcaaaacaatgttactctctttgtacattgtacagatgcaggataacaatgcagtgttatcctgcatctgtacaatcaagcacccaaactggttctgtagaggcaggaccttagcatatagcagagataacttatcttccagcagatccggagctccattttgtagacagaaatgaatgctctgtgccacagaaggagctgttgcactattcattcccgtttcctcccattcactctccacatctccaatcctggcattgtctgctttgttacttgttaaaaacttgatttcgtagattgctttaaaataagaacaaaatgtactttgacacacatcattttgtttggttctcattaattttgagagaaaggcaagatagatatttaaatgacccctattttagtggtaaacaagctgaaattagataaataaaatgatttgcctaatgc

SEQ ID NO: 138779 - DNA, 2648 bp, Homo sapiens; identical to SEQ ID NO: 138776
  Payload ID: 7186
  Gene Symbol: GREM1
  Gene Name: Gremlin 1, DAN family BMP antagonist
  ENST ID: ENST00000632478
  CDS Start-End: 160-591

SEQ ID NO: 138780 - DNA, 623 bp, Homo sapiens; identical to SEQ ID NO: 138777
  Payload ID: 7186
  Gene Symbol: GREM1
  Gene Name: Gremlin 1, DAN family BMP antagonist
  ENST ID: ENST00000633992
  CDS Start-End: 160-288

SEQ ID NO: 138781 - DNA, 14606 bp, Homo sapiens; identical to SEQ ID NO: 138778
  Payload ID: 7186
  Gene Symbol: GREM1
  Gene Name: Gremlin 1, DAN family BMP antagonist
  ENST ID: ENST00000632802
  CDS Start-End: 190-744

SEQ ID NO: 138782 - DNA, 4170 bp, Homo sapiens
  Payload ID: 7187
  Gene Symbol: GREM2
  Gene Name: gremlin 2, DAN family BMP antagonist
  Uniprot ID: Q9H772
  ENST ID: ENST00000318160
  CDS Start-End: 268-774
aagtctccgggctcctttcacatctgcaggagcagccagcctgggaccgcgcggcgcggggcgcgctctcgcctctcctgcaccctcagccggcgcgcttctcttatgggcgtctgctgcagtctggctgcggtcgaactgaaagcggcggcgggagaccaaacttagaccccgctgtggactagagaactcagagaaggcagagggagagggagagagagagagagaagggacccgaggaggaggcttccatcacgtcattgcaggatgttctggaagctttccctgtccttgttcctggtggcggtgctggtgaaggtggcggaagcccggaagaaccggccggcgggcgccatcccctcgccttacaaggacggcagcagcaacaactcggagagatggcagcaccagatcaaggaggtgctggcctccagccaggaggccctggtggtcaccgagcgcaagtacctcaagagtgactggtgcaagacgcagccgctgcggcagacggtgagcgaggagggctgccggagccgcaccatcctcaaccgcttctgctacggccagtgcaactccttctacatcccgcggcacgtgaagaaggaggaggagtccttccagtcctgcgccttctgcaagccccagcgcgtcacctccgtcctcgtggagctcgagtgccccggcctggacccacccttccgactcaagaaaatccagaaggtgaagcagtgccggtgcatgtccgtgaacctgagcgactcggacaagcagtgagcgccgggccggacgcagctcagccccgcgcgcgcccggccgctgggtggcgccgccgccgcctctgtccctgccctccgagcccactgtcacgctgcctggtgttccccctcagcagcaagcacttctcttagggctgacggtgtccttgtcacagacgtggatcgcaagtggagcttttgctgatgtgttcctgaccgaccccgggtcccacctgtgccccctaaaccaggcggtggatcaggcccgaaggaaaatgctggaaaaccaccaccgccacccagcagtcagagaggacctttcgaggtgatgcactgtaaatccggcattgatgtttccaccatgtggaaaagcaaggatttccctggccccgccctgcactccagctcgcccctttcccgcgcgaagtgaaggatgcgtcacttttctgagcggcccctcagacctctcctgctggtccctggacctctggctgggagcgctcattcttgtgactggcaggctgccctcggtcgctgctgtgatgaggatatgtgcaacctccataaatatgtcggtggacggggcgtctcctaataaacctgataccaagaagacaacttgagccacttggatcccgaagtgggcttcccgggaaacctcgagcagagcaggctacacaatcccccatcctcaagtccccaccgcctcttcttcctcactgtccccgccccctatttgtggactaaagatgaactctggtgtgcatgctattattgctgcaattagaatattatcacacacaaaggtctctatattaacgctggttttataagtgaccgtatattgtaaagagctgttaaaaagtattatagacctattcatgtattatttcacatgttttgactctggcttgcagcaccattcggagtaaggatgacagcaggcccagaaggtgtcttactcagaaaaaaaaatgcctggtcagcaattcactgtcatgcacctatttttagattgggcagggagatgggaggagtcgtgatttttactttgaatactatttcactgacgttactaagcattgcagcacaatgtagaaattggcttgggatggataggtatagggaagggcattcgttgggaaattgatgaccggaaactagaaagcccctataatgtggaatatgcatatgtggggtgaaaccgtatactactttcactgccatgacactaggcaaaaaatatttcctgttaaaagaaagagaaaaagagagggatattgaaaaatataaggagttgagtcgctttgtggtatagaagggagtaaggaataaaagatatagaatagtaatctagttgaactgttctgcacaaaacatgcttccttttcaaagaatagacttcaaaagggacgaacaaacattaggtcaccttttgtgtttataatgaattgttgacgtttccatgctgtggtctcttgatatacggaagtagacgtaacttattttccagcgaaattatatacttcttctgggctcctttgctcagttgccccaggaaggcttccctgtgagtaatgcttatggaatctgacaaatgtgaatgagctgccattggtgggaatcagtaaactttgaaaacctttcactgatgattccctggtaagtgctcctgtgaggggccacttccctagtatgtgagagagaccctctgcaagccgctgtggggacttagcttcctgatactaggtagtgatggtggatctagagacattcacttgaagagcaaggattggggtggggtgggttggtgaatctatctcaggccactgcactgcaaggtgcatttctgtcatttctgcaacaccatgagacctgagcaagaatgtgctgtggcagagggggtcttggtttcataaatgggtatatacagcctgaactcaggaggcagaaatcaaaagaaatccttgagggctggaacctgaggatagagcgaaaatggagagaagggtgttcaaggtcaggagtgatttttgcatttggtggaaaacctcaagtcagactcagtggcagaacatgcagcagaaaagctgtgaaggaaggaaatttacgtgattgtaatggaggctaggggtggattgggaggtgagtggaggagagtctctgaccagctgcagagccaacccctatcattttattaacatggaacccacacagataggggagggattaagctaagaacttacagaatgcaaacacgagcacactctcttcgaacccaattgtgggtgtagcaatgaaagcaatatgatatgctgcagtgtgaagctccttctggggttatcgtatgtacaaagtttaccttataatggctcaaattgtatttaatttttttgttttgtttataaatgaagaaaagctataagtataatgtaattattttataggtatactattaaattatagaacaaataaagataatctaggattatatgtgatcccggtgtgacgtgccataaaagtggaatttttgacttgttgcagtgagctgtgaagcagcactatgcgttcagagagtttttgttcaaccatggtgagttcaacctctagcttatgtcacatgatctcctttggggtctggaatcttctaagagaaatagaatcaggcatccaaggagcagaagtgatggaggtggccctcaatcctggtctttggaagcttccaagcctcttccacatcccctgccagctgaagacagagtattctcactgtgctggctgaaggagaaacactaaacaaggaaaccttgagaaactgcagcaatggaagtccactgttagtctctccgttagcaccagggacacacttgttctgagttttgttcattttcacatttactcctcatgagttccaacatttcttaatttaaatatttcttagtttatagcatctccatttttctattaattgacttaatctgccatttaagaaaactccgtaatcaataaaaaataaaatccacaatcaaactgcacatggttgatccactgtgtaggcttcaaaggaattaaactcaacttcctaggaaataattcatcttagtttattaaatgggacagaatatttcactgctaacgtattctaactcacttgtttttgaaattggccagatgatttttaagttataaagtcaatgaaaatgacttttgctattgtgtgaacaacttagaatgtatatattcccagaaggcttatttaatgattgacctatcaccactgattattaatgtctgcatgaatgataacaataagaccaagtcatcaataatgcaatgaaaattttttaagtgaaagcaagtttattaagaaagtaaaggaataaagaatgcctacttcataggcagagcagcctaa

SEQ ID NO: 138783 - DNA, 6666 bp, Homo sapiens
  Payload ID: 7188
  Gene Symbol: GRSF1
  Gene Name: G-rich RNA sequence binding factor 1
  Uniprot ID: Q12849
  ENST ID: ENST00000254799
  CDS Start-End: 119-1561
agtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctactctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatcagtagtactgcctagatggaaatgcgttttcatatatggttgaatatgccaagctatgagaactggtatctgtagttgtacgaactattagaatgtgatctttgttgctctttcacatttggtatctgatttgctgtggaaaagatctgtggggcctactgtgaggaattcatctgcaattgatttaagctaatgagttttatttgcacatctctggaaaaagaatgcaagcaaagcattaaaatgctatatgatggatgggtaaggttgaaaggatatatcttcttggcacgctacaggctgagttttctgtacaaaatgtggccattattgggaaatcattttatgtatttgaatgctcccttttgtttttgttcatgatctaggctagtacgtaagtgattgctaaggtggatgtagttatgggaaaggaagagaagcacataatacagtaaaagtaatcttatttccatgcaagtggaagacggtaccgtctccccacatttgagaagactgttttgcatcactctttgctattgaaggaagcagtgatggtgaatttccttctgtttgggttccttgtgtctataacttcctttgtggtaaagccatcaggaagaatagtgggagtggggcatatggtcagggtgctcatatcctgctttagcctagctgctgcttacggagtgcaagggagaactctgagaagcagtatgtaaataccagggagctgattgctgaatattgtggtctcatctgaatattgtggtctcatctaaatattgacaccaggcaatgaagcagaaatagagtatgtgtccctttatgcgtgggtaacttaagcttctgtcatgtgggaagggggaccgaatcttccctgggaggaaggctccaaattctcactacttctgtgttacttgaagggggaagcataaggaacccagtttgaaggcaacattgtgtgccatgaatctgcttattaatcaacatgccttgttaatgtcctctgccctgaacagcccttactcagttctcatttggaaagttattttttggggttacatcctgtttgtttcagaatttaaaaccctccatggtgggtcacttgaggtcaggagttcaagattagcctggccaacttagtgaaactccggctctactgaaaatgcaaaaattagccaggtgtggcacacgcctgtaatcccagttacttgggaggccaaggcaggagaatcgcttgaacctgggaggcagaggttgtagcgagccaagatcacaccattgcactccagcctgggcaacagagtgagactctgtcaaaatcaaaaaaaccaaaatacaaaaaactccattgttctgagagtttcccctaaattatcggaagacactcacattgaattggtaggacctatagtatagaggagaatggtatgtatgtcagcagtagagttccaatccaaattgcgctatcgcattagaaatacattaccctcccactccccaagttcagcaaattagaagagaatctgaagtttgtaggaagggaataaagctgctataaacatttatgtgcaggtttttgtgtagactcgttttcagctcctttgggtaaataccaaggaaccaggttgctggattgtaagttaagagtatgtttagttttggaagaaactgccaaactgttccaacatgactattttgaattcccattgacaatgaataagagttcctgtagctcctcaccctcattagtatttggtgatgtcactcttgcattttagctaatgggtgaatagtggtctcatcgttttaattcccaatcccatagtgatgtggagcaccttttcatatacttaatctgccatccttatatcatcattggtgaggtgtctggattttctgtccagaattttagttctagtggttttcttatttttagaaaggaagtataggaaggaaggtttaatctgtcttaagcctgattatatgaaaatcaagaataggctaggtgtggtggctgacatctgtaatccccgcactttgtgaggctgaagtgggaggactgcttgagcctgggaagtcaagcctgcagtgagccatgactgttgctgcactccagcctgagtgacagagtgagaccctgtctcagaaaaaaaaaaagcaggctcattttaaagttgtttatattttattttttgaaggaaataaacttgaagagatacaaacggtagtgaagattctccttcccctcctgtaattcagctgtttagtttctattctcgcacagccctgttatcagtttctagtgtaagcttgcagtgacttttactttatttataagcaagtgttagtgggtgttgtcatttcttttaaaaatataaattatactgtacatgctattttgtattttggcttttctcccacctaaacaccctaaagatcattttctgtcagtatataaaatcttggtgatgccaatacccatcccttagattgtacaagcagcattttgccatgctttatcccatagcctgcctcctgcagtctcatctttttttctatatgcatgtccaagtaagttgtagacatttttcacttttaatcctttcagcatacatgtcatgggaatttgtttttgtttttgttttttgtgtttgagacagtcgctctgtcacccaggctggagttatagtgacgtgatcccagctcattacagcctccacctcccagtttcaagcaattctcatgcctcagattcccgagtagctgggattacagatgtgcaccaccacgcctgactaatttttgtatttttagtagagatggggtttcatcatgttggccaggctggtctggaactcctggcctccagtcatttgcctgcctcggcctcccaaagtgctgggattacaggcatcagccaccacacccagccgtcattggagtttttttgagggagatttgcagtaaggtgaataaatgttaagtgtatcatttgatgaggttttttctttttttttttttttttttgagatggagtcttgtatcgcccaggctagagtgcagtggcctggtcttggctcactgcaacctccacctcctgggttcaagggagtctcctgcctcagcctcccgagtagctgggattacaggtgtgagccaccatacccagactcatttgatgagttttgatgtaaaagcatgtaactcaaacccctatgtctggaacatctgtattacatctgaattttttcacctagtcaattcctgcacctctctctcctgtcccttcttccctcccctggcagtcagctactgttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaacgtttcacctgttaggtgaacaactaactggtgaacaatgggctgtttctagtttggggctatcatgaataaagttggtatgaacatgtacaac

SEQ ID NO: 138784 - DNA, 1765 bp, Homo sapiens
  Payload ID: 7188
  Gene Symbol: GRSF1
  Gene Name: G-rich RNA sequence binding factor 1
  ENST ID: ENST00000514161
  CDS Start-End: 1-1253
acccgcccccgtccaccctgtgctcctattgggccctggaacaagggaagctctcccaggcgtcgggtcttctgcttgttttgttctcgcctcgagtctctggtcggttgggcagtgtaagtgtggctggggtgaatgttgaggccttgttccccgcctggcccatggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaata

SEQ ID NO: 138785 - DNA, 1794 bp, Homo sapiens
  Payload ID: 7188
  Gene Symbol: GRSF1
  Gene Name: G-rich RNA sequence binding factor 1
  Uniprot ID: Q12849
  ENST ID: ENST00000502323
  CDS Start-End: 263-1219
gcacacagttgcgtgggctggcttgtagggaaggagcctgtccccatcgcgccgttccctctcctgtccccagggaaagacgagctgtcccggtttactgaaggtcacctctgcaactccactcatacagaaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaa

SEQ ID NO: 138786 - DNA, 2491 bp, Homo sapiens
  Payload ID: 7188
  Gene Symbol: GRSF1
  Gene Name: G-rich RNA sequence binding factor 1
  ENST ID: ENST00000499044
  CDS Start-End: 1-1362
gcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgagtctctggtcggttgggcagtgagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatc

SEQ ID NO: 138787 - DNA, 925 bp, Homo sapiens
  Payload ID: 7188
  Gene Symbol: GRSF1
  Gene Name: G-rich RNA sequence binding factor 1
  ENST ID: ENST00000506453
  CDS Start-End: 1-345
aaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcagatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatcc

SEQ ID NO: 138788 - DNA, 2682 bp, Homo sapiens
  Payload ID: 7188
  Gene Symbol: GRSF1
  Gene Name: G-rich RNA sequence binding factor 1
  ENST ID: ENST00000545193
  CDS Start-End: 54-1328
caccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgcgtcctactctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctg

SEQ ID NO: 138789 - DNA, 1516 bp, Homo sapiens
  Payload ID: 7189
  Gene Symbol: GCOM1
  Gene Name: GRINL1A complex locus 1
  ENST ID: ENST00000380568
  CDS Start-End: 3-1340
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 138790 - DNA, 1846 bp, Homo sapiens
  Payload ID: 7189
  Gene Symbol: GCOM1
  Gene Name: GRINL1A complex locus 1
  ENST ID: ENST00000380569
  CDS Start-End: 128-1780
gcggtgcagctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 138791 - DNA, 2601 bp, Homo sapiens
  Payload ID: 7189
  Gene Symbol: GCOM1
  Gene Name: GRINL1A complex locus 1
  ENST ID: ENST00000488175
  CDS Start-End: 3-1403
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccaggtgcccatcccaacgttactattatatcataatttgattctccctccccccatccccccgccaactctgtaaaccccaagtataacacaggacgttgctatttgttgactgacacatagtgcttggtgaggtcacgctggcgctgaatactttttgtataaaccgacgaacagctgatgaccgcatgaatgctcacacaaggggaaagggcgccaagccaaggagccggcgtcatccgacgtaacttccgccctttaacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacga

SEQ ID NO: 138792 - DNA, 2275 bp, Homo sapiens
  Payload ID: 7189
  Gene Symbol: GCOM1
  Gene Name: GRINL1A complex locus 1
  ENST ID: ENST00000471563
  CDS Start-End: 3-1196
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagataaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccagtgcttggtgaggtcacgctggcgctgaatactttttgtataaaccgacgaacagctgatgaccgcatgaatgctcacacaaggggaaagggcgccaagccaaggagccggcgtcatccgacgtaacttccgccctttaacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacga

SEQ ID NO: 138793 - DNA, 2508 bp, Homo sapiens
  Payload ID: 7189
  Gene Symbol: GCOM1
  Gene Name: GRINL1A complex locus 1
  ENST ID: ENST00000468886
  CDS Start-End: 3-1310
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccaggtgcccatcccaacgttactattatatcataatttgattctccctccccccatccccccgccaactctgtaaaccccaagtataacacaggacgttgctatttgttgactgacacatagtgcttggtgaggtcacgctggcgctgaatactttttgtataaaccgacgaacagctgatgaccgcatgaatgctcacacaaggggaaagggcgccaagccaaggagccggcgtcatccgacgtaacttccgccctttaacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacga

SEQ ID NO: 138794 - DNA, 1536 bp, Homo sapiens
  Payload ID: 7189
  Gene Symbol: GCOM1
  Gene Name: GRINL1A complex locus 1
  ENST ID: ENST00000477282
  CDS Start-End: 3-1142
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 138795 - DNA, 2032 bp, Homo sapiens
  Payload ID: 7189
  Gene Symbol: GCOM1
  Gene Name: GRINL1A complex locus 1
  ENST ID: ENST00000496101
  CDS Start-End: 3-1250
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagaataatgaactacaaagcaggttggactatttaacagaaacccaggccaagaccgaagtggaaaccagagagataggagtgggctgtgatcttctacccaggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccagtgcttggtgaggtcacgctggcgctgaatactttttgtataaaccgacgaacagctgatgaccgcatgaatgctcacacaaggggaaagggcgccaagccaaggagccggcgtcatccgacgtaacttccgccctttaacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacga

SEQ ID NO: 138796 - DNA, 1694 bp, Homo sapiens
  Payload ID: 7189
  Gene Symbol: GCOM1
  Gene Name: GRINL1A complex locus 1
  ENST ID: ENST00000463717
  CDS Start-End: 3-1247
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagggaaggaaaggcctaaaagggagactaaagatgagttgctaaaaaagagagaacagaagcaaagagaccagaaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 138797 - DNA, 3156 bp, Homo sapiens
  Payload ID: 7189
  Gene Symbol: GCOM1
  Gene Name: GRINL1A complex locus 1
  ENST ID: ENST00000460962
  CDS Start-End: 3-1319
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaaatacctagcagaagaatggctgggtcaaacggtatattttaagaaactgccaaactggtttccaaagaggttgtactattttgcattcccattagcagtgtatcaaagttccagttgctctacatcctttacaacacttggaatggtcagtctttctggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccagaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 138798 - DNA, 2500 bp, Homo sapiens
  Payload ID: 7189
  Gene Symbol: GCOM1
  Gene Name: GRINL1A complex locus 1
  ENST ID: ENST00000496627
  CDS Start-End: 3-1175
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagatcatgtcgcacgagctcttctccagatttagtctccggctctttggaagatgataagttggtagcctgctctgggttggaagcgattcctttattgttcgtgattagaagaacacttgtacactctctgctgggaagaggtggtatttatctatgatgagccaatgaacaaaacaggaaggacatattatttaaaggaaaatttgaccatgtggggctcttgtttgtgaaaacacccacatactgtcaccctgacttgtacagcctcaaactgcagagtcaagagaactcacagatccacagagtatttttaggaacttgagtagacattgaagaaggaactgcaatgaaaaaggctactgaaaaaccattcagaaagatccaggtggaggcttggaagatgaatccttacttatggaaaagctgccaaagacatctgctaaggagatgggaagagagcttgaagaatgttagtgctctgggaaggaggtgctcccaccagatcacccccaagaaagtacaggagcagccagattgaatcattaaagaaaaagttgcaacagaaacagctcttaatactgcagcttttagaaaagatatctttcttagaaggagagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcagggaaggaaaggcctaaaagggagactaaagatgagttgctaaaaaagagagaacagaagcaaagagaccagaaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 138799 - DNA, 1620 bp, Homo sapiens
  Payload ID: 7189
  Gene Symbol: GCOM1
  Gene Name: GRINL1A complex locus 1
  ENST ID: ENST00000482814
  CDS Start-End: 3-1226
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 138800 - DNA, 2329 bp, Homo sapiens
  Payload ID: 7189
  Gene Symbol: GCOM1
  Gene Name: GRINL1A complex locus 1
  ENST ID: ENST00000587652
  CDS Start-End: 22-2319
gctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctc

SEQ ID NO: 138801 - DNA, 4149 bp, Homo sapiens
  Payload ID: 7190
  Gene Symbol: GCC1
  Gene Name: GRIP and coiled-coil domain containing 1
  Uniprot ID: Q96CN9
  ENST ID: ENST00000321407
  CDS Start-End: 426-2753
acggaagcgccgttgtcggcaggcagctttagttaggatgtcgtgatgggaccgagctcagcgtaaccctctggccgacgtgggccgagggggccggcccgggctgctgtggcccagacgagcggagagtgcggagcggcttctgggccagcgctaacgagccctggcagtgcgcacctctggtgccagtgtcgccccgcctccggggtagaatccgccccagccctccgggcctgggaccgggcggccgctttcgccagtccgtccggccgttccgcattaggtccgggataactaggtggagtaggtgtgcggcccgccgccggacagcccgctcgctgtttctttaagcccccgcctgcgtcttcacggccctctcccgttctgctggaaagctgacgtggggcaatccgttcagaccctccatggagaagtttgggatgaatttcgggggcggcccgagcaagaaggacttgctggagactatagagacccagaagaagcagcttctccagtaccaggcacggctcaaggatgtggtccgtgcctataaaagcctgctgaaggagaaagaggcattagaggccagcatcaaggtgctgtcggtatcccacgaggcagatgtgggcctcgcaggtgtccagcttccaggcctcacctttcctgactctgtggatgaccggtgctccactcacagcgaggatagcactgggaccgccactagcttggatactgcggccagtctcaccagcaccaagggtgagtttggggtagaagatgacagaccggcccgtggaccaccacctccaaagtccgaagaggccagttggtccgagagtggcgttagcagtagcagtggggatgggccatttgcaggtggggaggtggacaaaagactgcaccagctgaagactcagttggctactttgaccagttctttggctacagtcactcaggagaagtcccgcatggaggcttcttacttggctgacaagaaaaagatgaaacaggacttagaggatgccagtaacaaggcggaggaggagagggcccgcctggagggagaattgaaggggctgcaggagcaaatagcagaaaccaaagcccggcttatcacgcagcagcatgatcgggcccaagagcagagtgaccatgccttgatgctgcgtgagctccagaagctgctgcaggaggagaggacccagcgccaggacttggagcttaggttagaagagacccgagaagccttggcaggacgagcatatgcagctgaacagatggaaggatttgaactgcagaccaagcagctgacccgtgaggtggaggagctgaaaagtgaactgcaggccattcgagatgagaagaatcagccagatccccggctgcaagaacttcaggaagaggctgcccgccttaagagccatttccaggctcagttacagcaggaaatgagaaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttgacctgtgtggt

SEQ ID NO: 138802 - DNA, 7537 bp, Homo sapiens
  Payload ID: 7191
  Gene Symbol: GCC2
  Gene Name: GRIP and coiled-coil domain containing 2
  Uniprot ID: Q8IWJ2
  ENST ID: ENST00000309863
  CDS Start-End: 715-5769
ccttcgggaaagggtggcctcgggccccctactctacagagtctcctcccacggctgcccagttccctggccgactatcttgcctccaccacatcaccatcagtaccgggcggctgcagggcagagctgtccagggacctcctcacagcctccagagtcaagaaatgcctcctcagggaagccctctaccgcatccctgacctgtgagtcacggagctcccgggcaccatgctggccacaaatgcctaaggagccccccggaaccagctgtgggtcccgcaggcactcgcaggctagcggacacctttggaggactgagagacctgtcctgcaatccaatgttcctcactctcacaagattttacagacgtggaaaccgaggcccgaggccccaaggggtaatcggcccgccttcccatgccaataaccggcagtggcgggacccacacctactccgtgacctgcaggcccaggggtcgagccccaggtagaacgtctagacggactccgcccttagcgccgtacggggaaccttctcccggacgcagacacggaagcggaagtgctgccgagctgtagctatggagacgtggggggcgggccgcccggagagcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaagcaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattatgctaagttaaaatacagtttagttatttgctttaaaataaactcttctttttttctttaaagtatactatctcaaaactcattatgttgtcagagccctagagctggctagtgtaacactgactatgagtaggtgggcccacacttgagttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaactgta

SEQ ID NO: 138803 - DNA, 1366 bp, Homo sapiens
  Payload ID: 7191
  Gene Symbol: GCC2
  Gene Name: GRIP and coiled-coil domain containing 2
  ENST ID: ENST00000393321
  CDS Start-End: 1-744
aatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaagcaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaatttgtattttaaggaaaacctctttaactagtgaagataggatttgctaaagctaaatttaaagatttacccccagatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaagtaagactgttagcagcactaacgctgtaccagacagcaatgtatttctttgttgaaacttctaatatgttgatccttgagataaatgcagattagaaaataaaaaatagacatttctaaa

SEQ ID NO: 138804 - DNA, 2908 bp, Homo sapiens
  Payload ID: 7191
  Gene Symbol: GCC2
  Gene Name: GRIP and coiled-coil domain containing 2
  ENST ID: ENST00000409896
  CDS Start-End: 160-2908
gtttgcttcctgctcctggttagcactgctgggagatcctgctatttttcgaacataaagcagtctaagaaggtttatatagtggtgtagtggaaggagcagtgacataggctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatag

SEQ ID NO: 138805 - DNA, 786 bp, Homo sapiens
  Payload ID: 7191
  Gene Symbol: GCC2
  Gene Name: GRIP and coiled-coil domain containing 2
  ENST ID: ENST00000409821
  CDS Start-End: 45-786
gcggtggcggcggctggttgcgggccggcggcgggctggcggagatggaggtaactcaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttga

SEQ ID NO: 138806 - DNA, 540 bp, Homo sapiens
  Payload ID: 7191
  Gene Symbol: GCC2
  Gene Name: GRIP and coiled-coil domain containing 2
  ENST ID: ENST00000447558
  CDS Start-End: 1-263
aggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaagcaaaagaaacagcttcagaaaaccatgcaagaattagagct

SEQ ID NO: 138807 - DNA, 6772 bp, Homo sapiens
  Payload ID: 7191
  Gene Symbol: GCC2
  Gene Name: GRIP and coiled-coil domain containing 2
  Uniprot ID: Q8IWJ2
  ENST ID: ENST00000482325
  CDS Start-End: 36-173
gcggctggttgcgggccggcggcgggctggcggagatggaggatcttgttcaagatggggtggcttcaccagctacccctgggaccgggaaatctaagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaagcaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattatgctaagttaaaatacagtttagttatttgctttaaaataaactcttctttttttctttaaagtatactatctcaaaactcattatgttgtcagagccctagagctggctagtgtaacactgactatgagtaggtgggcccacacttgagttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaactgt

SEQ ID NO: 138808 - DNA, 982 bp, Homo sapiens
  Payload ID: 7191
  Gene Symbol: GCC2
  Gene Name: GRIP and coiled-coil domain containing 2
  ENST ID: ENST00000462897
  CDS Start-End: 1-441
cttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaataggaaaaaatcgactagaaaggggaaaattattgctgcagaagaaggagggagaattgttgctctgatgcttgagtaggtaatgagacgcaggatgaaatgcagatgtggaacaattggcctttgctccgcacacagacacttcactatggcagccagagggaaggcaccggtgcaagtaaattaataggccaggacagaaattcagatcataactgaatttttagaaacaaataccaagaagtcctgaactcaggagttcaagctaaagaagttaacagagatcaatattggataggtaaaacatattacaggtttcgttgtgaaaatcagacccagcagccaagaggaggagtgcacttatggagcataaatgttgatctgcatctgatatctctgatacttgatcctaatttgcacactatcacctaaagtcctagcatacctgcatttccaggaaatctaatgagaaagaagtcctgaaagcctctaattcctggaaacatatgaaacggctagaaaaaagtagactattttggaggattaaagacaatggaaactttttacattgtttgtctcacataatgaataaaattccactttaaaaaa

SEQ ID NO: 138809 - DNA, 774 bp, Homo sapiens
  Payload ID: 7191
  Gene Symbol: GCC2
  Gene Name: GRIP and coiled-coil domain containing 2
  ENST ID: ENST00000492785
  CDS Start-End: 1-383
agaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaataggtaactatggttttgcagatgttgtcacaattaattagacagattcttcttagtgttagaatagattgggaaatatagtagccaaataatgagttgttaaaaacacagttcgtagctgtcttttcctcgagctcacattcttgcccctctaacacctgtttgccttctctttcaaaagtgttactttctattgtttaacccaagcaagattggtgtgatttataaatggcttcatgatttattttggatttttcattcatttagcaaattttatttaaatgcccaactattctagaccctggtgatagaaaagtggttgaggtacagaccatgtgctcagagatctcactgttgtttgaggtgtggacaagatacagtactaacagcataggaacttaacactgttttgagttaaaaaaaaaaaaaaaa

SEQ ID NO: 138810 - DNA, 2356 bp, Homo sapiens
  Payload ID: 7191
  Gene Symbol: GCC2
  Gene Name: GRIP and coiled-coil domain containing 2
  ENST ID: ENST00000614209
  CDS Start-End: 288-2339
tgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaacaataaactcagttcagaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctaaaaaatgatcctctgtcttcagtaa

SEQ ID NO: 138811 - DNA, 3031 bp, Homo sapiens
  Payload ID: 7192
  Gene Symbol: GRIPAP1
  Gene Name: GRIP1 associated protein 1
  Uniprot ID: Q4V328
  ENST ID: ENST00000376423
  CDS Start-End: 36-2561
gcgcagaaagctggcgggggggtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcctggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggtgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactctttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 138812 - DNA, 2908 bp, Homo sapiens
  Payload ID: 7192
  Gene Symbol: GRIPAP1
  Gene Name: GRIP1 associated protein 1
  ENST ID: ENST00000593475
  CDS Start-End: 6-2438
ggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcctggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggtgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactctttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 138813 - DNA, 2881 bp, Homo sapiens
  Payload ID: 7192
  Gene Symbol: GRIPAP1
  Gene Name: GRIP1 associated protein 1
  ENST ID: ENST00000622599
  CDS Start-End: 21-2411
gggggggtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcctggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggtgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactctttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 138814 - DNA, 553 bp, Homo sapiens
  Payload ID: 7192
  Gene Symbol: GRIPAP1
  Gene Name: GRIP1 associated protein 1
  ENST ID: ENST00000611705
  CDS Start-End: 485-553
gcagaaagctggcgggggggtggggggaggaacatggcgcaagctctgtctgaggaggagtttcagcggatgcagtacttggagagacagatcactgggtcctggagaggacaggagtaggaaagattctgtgaaggccaagccctctgaccttgagcagactaccagagaacaacagagtctttctctgtcacccaggctatagtgtgcagtggcacgatctcagctcactgcaacctccacctcccgggttcaagtgattctcctatctcagcttccctagtagctgggattacaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgag

SEQ ID NO: 138815 - DNA, 531 bp, Homo sapiens
  Payload ID: 7192
  Gene Symbol: GRIPAP1
  Gene Name: GRIP1 associated protein 1
  ENST ID: ENST00000617369
  CDS Start-End: 323-531
gcaagctctgtctgaggaggagtttcagcggatgcagtacttggagagacagatcactgggtcctggagaggacaggagtaggaaagattctgtgaaggccaagccctctgaccttgagcagactaccagagaacagctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagc

SEQ ID NO: 138816 - DNA, 471 bp, Homo sapiens
  Payload ID: 7192
  Gene Symbol: GRIPAP1
  Gene Name: GRIP1 associated protein 1
  ENST ID: ENST00000621664
  CDS Start-End: 1-184
cagccaggaggaggacttccgtttgcagaacagcacactaatggccgagttcagcaagccctgcaggaacgctatgggaaagaagccgggaagttctcagctgtcagtgagggccagggggatcccccagggggcctggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcag

SEQ ID NO: 138817 - DNA, 904 bp, Homo sapiens
  Payload ID: 7192
  Gene Symbol: GRIPAP1
  Gene Name: GRIP1 associated protein 1
  ENST ID: ENST00000619107
  CDS Start-End: 1-904
ggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatgg

SEQ ID NO: 138818 - DNA, 367 bp, Homo sapiens
  Payload ID: 7192
  Gene Symbol: GRIPAP1
  Gene Name: GRIP1 associated protein 1
  ENST ID: ENST00000622231
  CDS Start-End: 5-367
gcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaaggaacgctatgggaaagaagccgggaagttctcagctgtcagtgagggccagggggatcccccagggggcctggcccccaccgtcctggccccc

SEQ ID NO: 138819 - DNA, 1972 bp, Homo sapiens
  Payload ID: 7193
  Gene Symbol: GC
  Gene Name: group-specific component (vitamin D binding protein)
  Uniprot ID: P02774
  ENST ID: ENST00000273951
  CDS Start-End: 345-1769
atattaagtaaactttagtgaggaacagcagtggaaaataatctatataccttggctcttttgcagtttgacaaagttaatgattaaaatctcctagattttccactacagtatccccagggtgtctatttaccttgattgatattattttatctcttttgggccaaagataacagccccttgcttctgtgtttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 138820 - DNA, 1777 bp, Homo sapiens
  Payload ID: 7193
  Gene Symbol: GC
  Gene Name: group-specific component (vitamin D binding protein)
  Uniprot ID: P02774
  ENST ID: ENST00000504199
  CDS Start-End: 96-1577
actgttttttcaaagagattgcttactccaccaggagaatgatatctacctattctaccactggtgatgatctggactagtccaactggtaggaaatgctgtggtcttggagtgaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccat

SEQ ID NO: 138821 - DNA, 1510 bp, Homo sapiens
  Payload ID: 7193
  Gene Symbol: GC
  Gene Name: group-specific component (vitamin D binding protein)
  ENST ID: ENST00000509740
  CDS Start-End: 48-1094
gtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataaggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgct

SEQ ID NO: 138822 - DNA, 1567 bp, Homo sapiens
  Payload ID: 7193
  Gene Symbol: GC
  Gene Name: group-specific component (vitamin D binding protein)
  ENST ID: ENST00000513476
  CDS Start-End: 29-1459
aggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagaccagagttggagccacccaggggaatgatctctgatgacctaacctaagcaaaaccactgagcttctgggaagacaactaggatactttctactttttctagctacaatatcttcatacaatgacaagtatgatgatttgcta

SEQ ID NO: 138823 - DNA, 562 bp, Homo sapiens
  Payload ID: 7193
  Gene Symbol: GC
  Gene Name: group-specific component (vitamin D binding protein)
  ENST ID: ENST00000506245
  CDS Start-End: 128-562
atcaaaattcgtagaaaataatctgagtgtgtctttttgaatgaactaatcagaagatgacgaaatacagttgaataaaagggatacagaagagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgt

SEQ ID NO: 138824 - DNA, 803 bp, Homo sapiens
  Payload ID: 7194
  Gene Symbol: GADD45A
  Gene Name: growth arrest and DNA-damage-inducible, alpha
  Uniprot ID: P24522
  ENST ID: ENST00000370985
  CDS Start-End: 295-690
agtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgc

SEQ ID NO: 138825 - DNA, 1496 bp, Homo sapiens
  Payload ID: 7194
  Gene Symbol: GADD45A
  Gene Name: growth arrest and DNA-damage-inducible, alpha
  Uniprot ID: P24522
  ENST ID: ENST00000370986
  CDS Start-End: 435-932
ctgactccaggagctggggtcaaattgctggagcaggctgatttgcatagcccaatggccaagctgcatgcaaatgaggcggaaggtggttggctgagggttggcaggataaccccggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttc

SEQ ID NO: 138826 - DNA, 1142 bp, Homo sapiens
  Payload ID: 7194
  Gene Symbol: GADD45A
  Gene Name: growth arrest and DNA-damage-inducible, alpha
  ENST ID: ENST00000617962
  CDS Start-End: 319-501
ggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttc

SEQ ID NO: 138827 - DNA, 1373 bp, Homo sapiens
  Payload ID: 7195
  Gene Symbol: GADD45B
  Gene Name: growth arrest and DNA-damage-inducible, beta
  Uniprot ID: O75293
  ENST ID: ENST00000215631
  CDS Start-End: 233-715
agatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctctg

SEQ ID NO: 138828 - DNA, 750 bp, Homo sapiens
  Payload ID: 7195
  Gene Symbol: GADD45B
  Gene Name: growth arrest and DNA-damage-inducible, beta
  ENST ID: ENST00000585359
  CDS Start-End: 214-396
ctaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaata

SEQ ID NO: 138829 - DNA, 765 bp, Homo sapiens
  Payload ID: 7195
  Gene Symbol: GADD45B
  Gene Name: growth arrest and DNA-damage-inducible, beta
  ENST ID: ENST00000587345
  CDS Start-End: 212-742
accgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacggtgagtcgggcctctgccctgccccgccacgcccgggcacctgggccggtgtttgtcaacaaagtcgggctgactggtcctgcacagctcagcgctcagccacgtttggcatgtcccgtgggcagccgggctggggcctcctcacccaggaagctattttgagcctgactgttttccccacacag

SEQ ID NO: 138830 - DNA, 373 bp, Homo sapiens
  Payload ID: 7195
  Gene Symbol: GADD45B
  Gene Name: growth arrest and DNA-damage-inducible, beta
  ENST ID: ENST00000593043
  CDS Start-End: 175-373
aacatgacgctggaagagctcgtggcgtgcgacaacgcggcgcagaagtaagtagccggggctgccgccgcctgaggtcagccgggacgggatgggtcgggttgggccgggccgggagcggaacgtagcacccggtggtccgcccgtcactgatccctctttcctggtctcaggatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttct

SEQ ID NO: 138831 - DNA, 276 bp, Homo sapiens
  Payload ID: 7195
  Gene Symbol: GADD45B
  Gene Name: growth arrest and DNA-damage-inducible, beta
  ENST ID: ENST00000587887
  CDS Start-End: 78-276
aacatgacgctggaagagctcgtggcgtgcgacaacgcggcgcagaagtaagtagccggggctgccgccgcctgaggatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttct

SEQ ID NO: 138832 - DNA, 1065 bp, Homo sapiens
  Payload ID: 7196
  Gene Symbol: GADD45G
  Gene Name: growth arrest and DNA-damage-inducible, gamma
  Uniprot ID: O95257
  ENST ID: ENST00000252506
  CDS Start-End: 110-589
cactcgctggtggtgggcgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaa

SEQ ID NO: 138833 - DNA, 977 bp, Homo sapiens
  Payload ID: 7196
  Gene Symbol: GADD45G
  Gene Name: growth arrest and DNA-damage-inducible, gamma
  ENST ID: ENST00000375769
  CDS Start-End: 396-821
gctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgtggttggagttggggagccaagggtgtgtgccggtggccggggctggggtctccgccgcgccctccggccggctcccgctcactgcgctggctcctccgcaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcc

SEQ ID NO: 138834 - DNA, 1782 bp, Homo sapiens
  Payload ID: 7197
  Gene Symbol: GADD45GIP1
  Gene Name: growth arrest and DNA-damage-inducible, gamma interacting protein 1
  Uniprot ID: Q8TAE8
  ENST ID: ENST00000316939
  CDS Start-End: 25-693
ctgtgaggaccccgcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaagagatctgcgtcctctcaaggtgtgcctctctgggtcccctggttcctcccccaatacttaagagctggggaatcccccacttggctgtactcaaaaggggacagggactctaggccctgctgactaactggggcttcagtgggaggaaaaggggggtgtacaatgggcaaataatggagaagcagatggcagaagagaagaaggcttctgtttaccaacattcatctccagtaattagccaattacaaggctggtggggggggaagtatagccaaaacagactgtggtgatgatggtgggggccggggagaagcagtccttgtaacgttgggctggggtccactgcctggaaatgacacactgggggaggagacaccggaagcctcaatctgcagggactcacagactcctctcccccttccaggcacccgtcaccatgcctgcctgtgcccagccagccccccaagacccagacaggtgggcgcggggagccccagcaggcacagaccatagggctagtttttaaaactttattcacttcaaaacctttatcagagacacggttctgttctggggtgggggtggccttgacaatgagctgatgttagcccttctccaggctggaggccaaggccagactggggagggggccttgggcctttcaggacttgccctagatggaaagatttgggccactccaatggaggatcaaagttggggctccagcttcccctcatcctagaagaggatgggggggggtcctcaggggtttttcggaggatggagaggcaagcagccgcctttccgtctggctgcagagagctgggacagaggccaagaggggcccatctgtcgcctcccagtcctgccagcttctctgagcaggctgggctggggaggaggacggggggacagctgtctggcccgggagatgggaacaggggccactttaggaggacaggaagctggactgtttgcttgtttttttaagatttttgatttttttttccatttcttaaataaacatgaatatatatata

SEQ ID NO: 138835 - DNA, 2827 bp, Homo sapiens
  Payload ID: 7198
  Gene Symbol: GAS1
  Gene Name: growth arrest-specific 1
  Uniprot ID: P54826
  ENST ID: ENST00000298743
  CDS Start-End: 411-1448
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatga

SEQ ID NO: 138836 - DNA, 2170 bp, Homo sapiens
  Payload ID: 7199
  Gene Symbol: GAS2
  Gene Name: growth arrest-specific 2
  Uniprot ID: O43903
  ENST ID: ENST00000278187
  CDS Start-End: 249-1190
gagattcacagaggcaaggcagagaacaagacctgtgcttctttactccaaactcttagcagtgtggacactgattaactgcagctggggtctgatttgcccagcctgtctttgatattgatcaatgaactccttctcaaggaatgctttcctctaactgcggtgaaggtggtggctctggtggttctctccaacatgggtgtctgggttttgactgcctaagagaaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaa

SEQ ID NO: 138837 - DNA, 2286 bp, Homo sapiens
  Payload ID: 7199
  Gene Symbol: GAS2
  Gene Name: growth arrest-specific 2
  Uniprot ID: O43903
  ENST ID: ENST00000454584
  CDS Start-End: 306-1247
ttttacttccgctcggtctatgaggactgatgaaatgtaggaaatctgtttctggcagggagaaaaaatcgttttcccaaacagcactaaaaggagccatcagagaagtatgaagaggggtagtgcggctgtagctgctgccgctgccgccaggctggtggggtgcggggagcggctgctgcaggacctgtgcctggagggggccggccccgagaagctgcaggagcccagcccggagcccaagcgcctctgagagccgccagcagcccagctcgggacgcgggggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtctctaaatcaatgcctcattctgaaatcaagttaattttcaaatggcaa

SEQ ID NO: 138838 - DNA, 2241 bp, Homo sapiens
  Payload ID: 7199
  Gene Symbol: GAS2
  Gene Name: growth arrest-specific 2
  Uniprot ID: O43903
  ENST ID: ENST00000524701
  CDS Start-End: 249-674
gagattcacagaggcaaggcagagaacaagacctgtgcttctttactccaaactcttagcagtgtggacactgattaactgcagctggggtctgatttgcccagcctgtctttgatattgatcaatgaactccttctcaaggaatgctttcctctaactgcggtgaaggtggtggctctggtggttctctccaacatgggtgtctgggttttgactgcctaagagaaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttgggatttggaggccagtgactatgcttcatctatttctctgagaaagaatctactcaacaagaaaaggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgtta

SEQ ID NO: 138839 - DNA, 736 bp, Homo sapiens
  Payload ID: 7199
  Gene Symbol: GAS2
  Gene Name: growth arrest-specific 2
  ENST ID: ENST00000528582
  CDS Start-End: 193-736
ccgtgcgaatggggccatgccgaccaaagcgccgatggatgtggcgcaggtagcgcgcccactgcaaggcccggcgcacggtggcggggtcccaggtgctgacgtaggtagtgcttgagaccgccagaagctcggaaaagcgatccaggtgctgcagaagggattccatgaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccc

SEQ ID NO: 138840 - DNA, 579 bp, Homo sapiens
  Payload ID: 7199
  Gene Symbol: GAS2
  Gene Name: growth arrest-specific 2
  ENST ID: ENST00000534801
  CDS Start-End: 115-579
taatagggtgtaggtaaagttactgaacagccacatctcactttcaggaaagtagtggaagagattgtgtcttgagaagacaggcattttagaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggatt

SEQ ID NO: 138841 - DNA, 547 bp, Homo sapiens
  Payload ID: 7199
  Gene Symbol: GAS2
  Gene Name: growth arrest-specific 2
  ENST ID: ENST00000533363
  CDS Start-End: 140-547
gttggacaggctctttctctaagagtgggtattcactgcagggggtgactttctgattctctggaaacaaccatgtgttccttatccctattgcggaacaccccggacaaccgcagcacgtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttg

SEQ ID NO: 138842 - DNA, 712 bp, Homo sapiens
  Payload ID: 7199
  Gene Symbol: GAS2
  Gene Name: growth arrest-specific 2
  ENST ID: ENST00000532398
  CDS Start-End: 98-712
cattataatgtcatgatgacaacattttgtgagagaagtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgca

SEQ ID NO: 138843 - DNA, 674 bp, Homo sapiens
  Payload ID: 7199
  Gene Symbol: GAS2
  Gene Name: growth arrest-specific 2
  Uniprot ID: O43903
  ENST ID: ENST00000630668
  CDS Start-End: 249-674
gagattcacagaggcaaggcagagaacaagacctgtgcttctttactccaaactcttagcagtgtggacactgattaactgcagctggggtctgatttgcccagcctgtctttgatattgatcaatgaactccttctcaaggaatgctttcctctaactgcggtgaaggtggtggctctggtggttctctccaacatgggtgtctgggttttgactgcctaagagaaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttgggatttggaggccagtga

SEQ ID NO: 138844 - DNA, 1803 bp, Homo sapiens
  Payload ID: 7200
  Gene Symbol: GAS2L1
  Gene Name: growth arrest-specific 2 like 1
  Uniprot ID: Q99501
  ENST ID: ENST00000406549
  CDS Start-End: 151-1515
gacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 138845 - DNA, 569 bp, Homo sapiens
  Payload ID: 7200
  Gene Symbol: GAS2L1
  Gene Name: growth arrest-specific 2 like 1
  ENST ID: ENST00000428622
  CDS Start-End: 140-569
gctatcgcttcctgccttcatcttgggaacaggccgtgctgtgcgccagcccggggagcccaccgtctggggaggggggcgattaaaaggtcccaacctcctccccaggagaccaaagagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtgg

SEQ ID NO: 138846 - DNA, 745 bp, Homo sapiens
  Payload ID: 7200
  Gene Symbol: GAS2L1
  Gene Name: growth arrest-specific 2 like 1
  ENST ID: ENST00000416823
  CDS Start-End: 331-745
cccgggaggaggtgactttgcagcctccagccgctatcgcttcctgccttcatcttgggaacaggccgtgctgtgcgccagcccggggagcccaccgtctggggaggggggcgattaaaaggtcccaacctcctccccaggagaccaaagaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgt

SEQ ID NO: 138847 - DNA, 2483 bp, Homo sapiens
  Payload ID: 7200
  Gene Symbol: GAS2L1
  Gene Name: growth arrest-specific 2 like 1
  ENST ID: ENST00000621062
  CDS Start-End: 150-2195
ggacgcatagagctgcggctcgggcggcgcctccctgcggcggcccggcccggctccggcccccgctggggcaatgctccccggggccgcgggatgagccagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 138848 - DNA, 2925 bp, Homo sapiens
  Payload ID: 7200
  Gene Symbol: GAS2L1
  Gene Name: growth arrest-specific 2 like 1
  ENST ID: ENST00000616432
  CDS Start-End: 592-2637
cgcggcggtgccgtttatctggccaggggaggtccacccgggaggaggtgactttgcagcctccagccgctatcgcttcctgccttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 138849 - DNA, 2482 bp, Homo sapiens
  Payload ID: 7200
  Gene Symbol: GAS2L1
  Gene Name: growth arrest-specific 2 like 1
  ENST ID: ENST00000611648
  CDS Start-End: 149-2194
atagagctgcggctcgggcggcgcctccctgcggcggcccggcccggctccggcccccgctggggcaatgctccccggggccgcgggatgagccaggtgagcgcggagacccccagcactccctgcctgtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 138850 - DNA, 3382 bp, Homo sapiens
  Payload ID: 7200
  Gene Symbol: GAS2L1
  Gene Name: growth arrest-specific 2 like 1
  ENST ID: ENST00000618518
  CDS Start-End: 1049-3094
atagagctgcggctcgggcggcgcctccctgcggcggcccggcccggctccggcccccgctggggcaatgctccccggggccgcgggatgagccaggtgagcgcggagacccccagcactccctgcctggtgcgcatggacgggggtggggaggcggggcgggaagcggcgtcctcggcctctgttccccggggctgtgtgaccttgggcggccccgcaccctctctgggcccagagccccagcaccggcagggcctgcggaggccgctctgagtcctggccccgcaggcaccggcctggagcgctggggaggcttcttggaggaggcggggcctggccctggccccggatcgccgagaccggccacgctgcgccgcctggacgccgggctcctccacccacagctctgcgaccttcacgagctcgaccctttctgcgcctcagtttcctcatctataaaatggagataatgcctccgcgcgctgagcccgagcgcggtcgtgctgttacactattgctgctgctatgtcgttaatgacggcacagcccttatggaaggggggccaaggaaggcacggggaccttcccgcaggacatggggtgggcaccagccctaagccatgcacataacccactctgaggtcaggacctgggttcctttcgtgtccactgggggccttagccgttgtcttcacttctctaggtcccagcccttcacaatgggcgcgcctccctgcctgagagggaggccccagccaagccccagtttccaccgcaaaaagccacacagcaaacacttaatggaccctaaatttataaaaattatcccatagagtcctatgaggcagggaatgttactgtacccatttcgcagatgaggaaacttggggcaccgacatttcccagagccaacatgtaaaccaggcatttggcctgagtgacagactggtgcaggtggccagcagcttaatttgtactgagcgcttactgggtccccacagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 138851 - DNA, 2238 bp, Homo sapiens
  Payload ID: 7200
  Gene Symbol: GAS2L1
  Gene Name: growth arrest-specific 2 like 1
  Uniprot ID: Q99501
  ENST ID: ENST00000610653
  CDS Start-End: 133-1146
gccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagc

SEQ ID NO: 138852 - DNA, 2661 bp, Homo sapiens
  Payload ID: 7201
  Gene Symbol: GAS2L2
  Gene Name: growth arrest-specific 2 like 2
  ENST ID: ENST00000604063
  CDS Start-End: 29-2623
ccacctcctgccctgctggggtccagccatgtcccagcctgcgggaggcaggaggaagcccaggaccctagggccgcctgtgtgcagtatccggcctttcaagtcgagtgagcagtacctggaggccatgaaggaagacctggctgagtggcttcgcgacctctatgggctggacatcgacgcagccaacttcctgcaggtgctggaaacgggcctggtgctgtgccaacacgccaacgttgtcactgacgctgccctggccttcctggctgaggcacctgcccaagcccagaagattcccatgccccgggtcggggtctcctgcaatggggccgcccagccaggtaccttccaggccagggacaatgtctctaacttcatccagtggtgtcgaaaggagatgggcatccaagaggtgctgatgttcgagacggaggacttggtgctgcgcaagaacgtgaagaacgtggtgctgtgtttgctggagctgggccgccgggcgtggcgctttggtgttgcggcgcccacactcgtgcagctggaggaggagatcgaggaggaggtgcggcgggagctgccctgccacttccgcaacctggaccagatggtgcagagccttgtgagccactgcacgtgcccagtgcagttctccatggtcaaagtgtctgaggggaagtaccgtgtgggtgactccaacaccctcatcttcatccggatcctccggaaccatgtgatggtacgtgtagggggcggctgggacacactgggccattacctggacaaacatgacccctgccgctgcacatccctctcacacaagccaggcagcttcctgaagcccccggccccaccagtgcagcatgaagtaagggtacaggatggaccctcacagacccagcctacaatgaccatcagccgctcacagagcccaccaccccctgtggactggaagacatatacctcttcagaccgaaggctgaggccccccaccccatcctcccccagaccccgcagggaacggggagcagggacgggggcctccagagagatggcaccattcctgaggtgccaggagaggtctctcatcccatcttggaggcagccgacagctggggacagcccacccagcccccagtcctcatctacccaaaaaggccgagacccacagtgtacctcgtcaggaaagagggaggagagatacccccctgaactccccaggggaaggattcccacatcttgggttcatgaagaaacagacagctggggaaccgacgccgggaaccccaccccacaaagactccgagccattgaggccaccaccaaagggatatcagcaagaggaccatctcccctgcctcgttcctttggcccagccgagtgcctgggcctcaggctgccactccgggatgaggccaagggtgcgttcttccagttcagggagccagagtctgtccgttctccaacccctgtccaaggcctaaccaagatccccatccggctgccccctgctcgccccccaacaccaggaaggagctttcctggtgctacaagtggaagtcccaggacagaacttgggagagaccccatcccactaagggccgtcactgtggacctggctgggtccacgcatggggactgctctgtggaagtgaggcaggaggaccagcagctggacatccaggtcatggcagaggccagagagtcctgggacctgggcctacaggagcaggaggggcggtacacacctctgcccttgggcgggaacaaggagcaagccatctactgtagccttgaagaggagattttgggcaacatgaagctgctagaagtcaggagtgcctgtccgcagggcacaaggtctggggtcatccctcgcagtggggtctacatccccaggctggctgggcagtggcctgagcctgggggtccttatgacaaagccatccaagaactggctcaggggtccccatccctccttaaagtggacctggaagcctggaaggcagccccgactggctcccctaagccagctgttaccccaggaccgggaagcctcaaagggaagttgggagccagacagagtgggcccaggacaaaggcaagcctgagtgccaagggcacccacatgaggaaggtcccacctcagggagggcaggactgctcggcttctactgtgtctgccagcccggaggcccccacaccttcgcccttggaccccaactctgacaaagccaaggcatgtctgagcaagggcaggagaactctccggaagcccaagagggtcccgtccatctacaagctgaagctgagacccaggattcggccccggagagaccacaggcctgagaagcagccttcacgaatccccaggccactggcctatgtcttcctgggtccagccaggcagccccccaaggacaggctgttgagagctgtgctgggcagcaagggaggggaggcatcccgggtggatggagcttcagtaggtgaggaggaggaggaaggaaaggaggagaaagagccagccgctccattggagagcagcccccaacctccagagggcctgcaacctcactggcttaatcaagctccacttccacctgaggaggagtcctgggtctgaggcacatgagcgtgttgggtaggagggaagcaaaaagg

SEQ ID NO: 138853 - DNA, 3014 bp, Homo sapiens
  Payload ID: 7201
  Gene Symbol: GAS2L2
  Gene Name: growth arrest-specific 2 like 2
  Uniprot ID: Q8NHY3
  ENST ID: ENST00000604641
  CDS Start-End: 29-2671
ccacctcctgccctgctggggtccagccatgtcccagcctgcgggaggcaggaggaagcccaggaccctagggccgcctgtgtgcagtatccggcctttcaagtcgagtgagcagtacctggaggccatgaaggaagacctggctgagtggcttcgcgacctctatgggctggacatcgacgcagccaacttcctgcaggtgctggaaacgggcctggtgctgtgccaacacgccaacgttgtcactgacgctgccctggccttcctggctgaggcacctgcccaagcccagaagattcccatgccccgggtcggggtctcctgcaatggggccgcccagccaggtaccttccaggccagggacaatgtctctaacttcatccagtggtgtcgaaaggagatgggcatccaagaggtgctgatgttcgagacggaggacttggtgctgcgcaagaacgtgaagaacgtggtgctgtgtttgctggagctgggccgccgggcgtggcgctttggtgttgcggcgcccacactcgtgcagctggaggaggagatcgaggaggaggtgcggcgggagctggccctgcccccgcccgacccctcgccgccagcgccccccaggcgccagccctgccacttccgcaacctggaccagatggtgcagagccttgtgagccactgcacgtgcccagtgcagttctccatggtcaaagtgtctgaggggaagtaccgtgtgggtgactccaacaccctcatcttcatccggatcctccggaaccatgtgatggtacgtgtagggggcggctgggacacactgggccattacctggacaaacatgacccctgccgctgcacatccctctcacacaagccaggcagcttcctgaagcccccggccccaccagtgcagcatgaagtaagggtacaggatggaccctcacagacccagcctacaatgaccatcagccgctcacagagcccaccaccccctgtggactggaagacatatacctcttcagaccgaaggctgaggccccccaccccatcctcccccagaccccgcagggaacggggagcagggacgggggcctccagagagatggcaccattcctgaggtgccaggagaggtctctcatcccatcttggaggcagccgacagctggggacagcccacccagcccccagtcctcatctacccaaaaaggccgagacccacagtgtacctcgtcaggaaagagggaggagagatacccccctgaactccccaggggaaggattcccacatcttgggttcatgaagaaacagacagctggggaaccgacgccgggaaccccaccccacaaagactccgagccattgaggccaccaccaaagggatatcagcaagaggaccatctcccctgcctcgttcctttggcccagccgagtgcctgggcctcaggctgccactccgggatgaggccaagggtgcgttcttccagttcagggagccagagtctgtccgttctccaacccctgtccaaggcctaaccaagatccccatccggctgccccctgctcgccccccaacaccaggaaggagctttcctggtgctacaagtggaagtcccaggacagaacttgggagagaccccatcccactaagggccgtcactgtggacctggctgggtccacgcatggggactgctctgtggaagtgaggcaggaggaccagcagctggacatccaggtcatggcagaggccagagagtcctgggacctgggcctacaggagcaggaggggcggtacacacctctgcccttgggcgggaacaaggagcaagccatctactgtagccttgaagaggagattttgggcaacatgaagctgctagaagtcaggagtgcctgtccgcagggcacaaggtctggggtcatccctcgcagtggggtctacatccccaggctggctgggcagtggcctgagcctgggggtccttatgacaaagccatccaagaactggctcaggggtccccatccctccttaaagtggacctggaagcctggaaggcagccccgactggctcccctaagccagctgttaccccaggaccgggaagcctcaaagggaagttgggagccagacagagtgggcccaggacaaaggcaagcctgagtgccaagggcacccacatgaggaaggtcccacctcagggagggcaggactgctcggcttctactgtgtctgccagcccggaggcccccacaccttcgcccttggaccccaactctgacaaagccaaggcatgtctgagcaagggcaggagaactctccggaagcccaagagggtcccgtccatctacaagctgaagctgagacccaggattcggccccggagagaccacaggcctgagaagcagccttcacgaatccccaggccactggcctatgtcttcctgggtccagccaggcagccccccaaggacaggctgttgagagctgtgctgggcagcaagggaggggaggcatcccgggtggatggagcttcagtaggtgaggaggaggaggaaggaaaggaggagaaagagccagccgctccattggagagcagcccccaacctccagagggcctgcaacctcactggcttaatcaagctccacttccacctgaggaggagtcctgggtctgaggcacatgagcgtgttgggtaggagggaagcaaaaaggatggccatgtatacactggattcacagctgcgggaacagaagggatgttccctcacctccacacagggccttgggcaggagtgggtcagaagacaaatatagactccatctgctcatctgagcaaaggggcaacccactgctctcactccaactccagaggtaggccaggggcagtaggaccatcctgtatctcattactctcccctagaacggctcaccacactcctggcctctggcccctggccatgcccacctgtttccataactcccataagttattaaatgcatgtgattctgcccttga

SEQ ID NO: 138854 - DNA, 2655 bp, Homo sapiens
  Payload ID: 7201
  Gene Symbol: GAS2L2
  Gene Name: growth arrest-specific 2 like 2
  ENST ID: ENST00000618498
  CDS Start-End: 29-670
ccacctcctgccctgctggggtccagccatgtcccagcctgcgggaggcaggaggaagcccaggaccctagggccgcctgtgtgcagtatccggcctttcaagtcgagtgagcagtacctggaggccatgaaggaagacctggctgagtggcttcgcgacctctatgggctggacatcgacgcagccaacttcctgcaggtgctggaaacgggcctggtgctgtgccaacacgccaacgttgtcactgacgctgccctggccttcctggctgaggcacctgcccaagcccagaagattcccatgccccgggtcggggtctcctgcaatggggccgcccagccaggtaccttccaggccagggacaatgtctctaacttcatccagtggtgtcgaaaggagatgggcatccaagaggtgctgatgttcgagacggaggacttggtgctgcgcaagaacgtgaagaacgtggtgctgtgtttgctggagctgggccgccgggcgtggcgctttggtgttgcggcgcccacactcgtgcagctggaggaggagatcgaggaggaggtgcggcgggagctggccctgccacttccgcaacctggaccagatggtgcagagccttgtgagccactgcacgtgcccagtgcagttctccatggtcaaagtgtctgaggggaagtaccgtgtgggtgactccaacaccctcatcttcatccggatcctccggaaccatgtgatggtacgtgtagggggcggctgggacacactgggccattacctggacaaacatgacccctgccgctgcacatccctctcacacaagccaggcagcttcctgaagcccccggccccaccagtgcagcatgaagtaagggtacaggatggaccctcacagacccagcctacaatgaccatcagccgctcacagagcccaccaccccctgtggactggaagacatatacctcttcagaccgaaggctgaggccccccaccccatcctcccccagaccccgcagggaacggggagcagggacgggggcctccagagagatggcaccattcctgaggtgccaggagaggtctctcatcccatcttggaggcagccgacagctggggacagcccacccagcccccagtcctcatctacccaaaaaggccgagacccacagtgtacctcgtcaggaaagagggaggagagatacccccctgaactccccaggggaaggattcccacatcttgggttcatgaagaaacagacagctggggaaccgacgccgggaaccccaccccacaaagactccgagccattgaggccaccaccaaagggatatcagcaagaggaccatctcccctgcctcgttcctttggcccagccgagtgcctgggcctcaggctgccactccgggatgaggccaagggtgcgttcttccagttcagggagccagagtctgtccgttctccaacccctgtccaaggcctaaccaagatccccatccggctgccccctgctcgccccccaacaccaggaaggagctttcctggtgctacaagtggaagtcccaggacagaacttgggagagaccccatcccactaagggccgtcactgtggacctggctgggtccacgcatggggactgctctgtggaagtgaggcaggaggaccagcagctggacatccaggtcatggcagaggccagagagtcctgggacctgggcctacaggagcaggaggggcggtacacacctctgcccttgggcgggaacaaggagcaagccatctactgtagccttgaagaggagattttgggcaacatgaagctgctagaagtcaggagtgcctgtccgcagggcacaaggtctggggtcatccctcgcagtggggtctacatccccaggctggctgggcagtggcctgagcctgggggtccttatgacaaagccatccaagaactggctcaggggtccccatccctccttaaagtggacctggaagcctggaaggcagccccgactggctcccctaagccagctgttaccccaggaccgggaagcctcaaagggaagttgggagccagacagagtgggcccaggacaaaggcaagcctgagtgccaagggcacccacatgaggaaggtcccacctcagggagggcaggactgctcggcttctactgtgtctgccagcccggaggcccccacaccttcgcccttggaccccaactctgacaaagccaaggcatgtctgagcaagggcaggagaactctccggaagcccaagagggtcccgtccatctacaagctgaagctgagacccaggattcggccccggagagaccacaggcctgagaagcagccttcacgaatccccaggccactggcctatgtcttcctgggtccagccaggcagccccccaaggacaggctgttgagagctgtgctgggcagcaagggaggggaggcatcccgggtggatggagcttcagtaggtgaggaggaggaggaaggaaaggaggagaaagagccagccgctccattggagagcagcccccaacctccagagggcctgcaacctcactggcttaatcaagctccacttccacctgaggaggagtcctgggtctgaggcacatgagcgtgttgggtaggagggaagc

SEQ ID NO: 138855 - DNA, 2218 bp, Homo sapiens
  Payload ID: 7202
  Gene Symbol: GAS2L3
  Gene Name: growth arrest-specific 2 like 3
  Uniprot ID: Q86XJ1
  ENST ID: ENST00000266754
  CDS Start-End: 134-2218
caggcggcggcggcagcggcggcggttggtcaggggcgtgttggccccgcacagattgagccgagttgtcgccccgctgggagaagtgaccctcctgcgcctgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataa

SEQ ID NO: 138856 - DNA, 2229 bp, Homo sapiens
  Payload ID: 7202
  Gene Symbol: GAS2L3
  Gene Name: growth arrest-specific 2 like 3
  Uniprot ID: Q86XJ1
  ENST ID: ENST00000539410
  CDS Start-End: 132-2216
cagtcgagtaaacacattcctaaatcttgtaatttgggggtttgggggagtagcaaaactgccactgttaactgtatgttaatattttgttcttttttcagaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcatt

SEQ ID NO: 138857 - DNA, 2742 bp, Homo sapiens
  Payload ID: 7202
  Gene Symbol: GAS2L3
  Gene Name: growth arrest-specific 2 like 3
  ENST ID: ENST00000537247
  CDS Start-End: 955-2727
atgtggaactccattttaataggagcagcttctttgctgcatttttaaaaaatggtcttggaagcttcttacttccgagaagtggatctttgttgcggacaaaggattatttatgctaaaggaaaatgtattccccactgaattagctcgtgggaagcataacaagctcattaggaatgctcacttgtactttggccttttgctgtggtggagagaagggaaaatgacatcaaaaaggacattctgttgtcttttgccttcctgcaaagaaaatgtgttataatattaggcttttcagtatggtttagctcaggttcaactttggtactagaagaaatgttcctgaaaggaaagtgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaaagagtcttgctctgttgcccaggttggagtacagtggcacgatcatagcttactgtatcctggaactactgggctcaagtgatcctctcacctcagcctcctgagcagctgggactttagctacatgcaaccacgtctggctaatattaaaagaaatattttgtagagatgaggtcacactgtttcccaggctggtcttgaactcctagcctcaagcaatcctgcttcagcctccgaaagtactgggattacaaaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattat

SEQ ID NO: 138858 - DNA, 567 bp, Homo sapiens
  Payload ID: 7202
  Gene Symbol: GAS2L3
  Gene Name: growth arrest-specific 2 like 3
  ENST ID: ENST00000550295
  CDS Start-End: 420-567
ctcttttcctggcgaacttttacgcgctgtctcggggcctccgcgcctcagcctgagggctccaggagccccccgctctctgaggccccgaagctgaggtttgttgggtctcccggctgcgggagccagtacgctctgcgtttgcctggctgcggcagtcgcgtgctctgattggctcctggggccgtcaagatcagaacactgaggctcagagaagttaactactccaaagtcatatagccagtattttctggagctgtaattcaaatcagatgtgttcaataccttctactaccccattgctgtctttatgatttgtaacagatggagccatgacattttgaattctccccatcataccgtataacgtgagaaaggattgaaaatgtaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgccca

SEQ ID NO: 138859 - DNA, 2340 bp, Homo sapiens
  Payload ID: 7202
  Gene Symbol: GAS2L3
  Gene Name: growth arrest-specific 2 like 3
  Uniprot ID: Q86XJ1
  ENST ID: ENST00000547754
  CDS Start-End: 227-2311
gtcaggggcgtgttggccccgcacagattgagccgagttgtcgccccgctgggagaagtgaccctcctgcgcctgatcagaacactgaggctcagagaagttaactactccaaagtcatatagccagtattttctggagctgtaattcaaatcagatgtgttcaataccttctactaccccattgctgtctttatgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattataaaaaaagagaaaa

SEQ ID NO: 138860 - DNA, 3948 bp, Homo sapiens
  Payload ID: 7202
  Gene Symbol: GAS2L3
  Gene Name: growth arrest-specific 2 like 3
  ENST ID: ENST00000552854
  CDS Start-End: 1-1176
gtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattataaaaaaagagaaaaggaagaatgaatgtgttagcttcacatcttaaaagtttctcctatttgtgtctgtctaaataggtgcagacactaaggatagtgaggatggaggctgggatgaggaaagggttcatcagaattcacatatctgaattcactggaaagagcccttctgaagcaaacagttgtaaaatcactgcaaggtttttattaataatagacatgtatatgattttcagtctatagcatctttgttaacatctgccttttgcaggaaatgtaaaagttatttaacactacaagaattttaacaatagttgctctatttttgaatatgtattaaatatggagttcatatacctgctaatatcaacggtggtgctcttactattagttaattgcattttggttaaaaaaaaaaaagcaacagtttggcacttgtcctacaaaaggcacctaatttaattttctgatcaggattgcctgatccaacagtgctaagtcatggctgctgctgactagcttggcattattctgtgttaggtagaattcttattatttatttttttaagctttccaaattggaaggaactgattgtttcatgtggcttatatttacattggtaatattttgtcaccaatatttttggttaaaaaaaatccaacaaattaacttactgaaatataaacaaattttgtaaacaattttttatattatctataaaaacgtagacaccttatgtttcacatgttgtgcaatgtgacaggggaagctgatttagtagcttttagcatattaaaaataattttttataatgtaatttcctgtgagtgcagacctgacattttacattaaaataatgtgaaacatcagaattatgttttaacaactttaaaattaagatgatgttaaaataattttagagttatgctatgtaaaaattctatcatgaaattatttttctctagatagcacaataccaattttaattaatttcttccaattaggttacttttctttaataaagttatgctgccttcagttttccaatggcaagtagacaggatatgttcaaggttttctgcactgtaggcacagtctctcaagcatatcctgatcatgtaatgactgcataaactccatcaacctaaggtgatacttgtaaataatttatttttaagggatggtgactttaaaaattattaatgaactttgagaagttttaagagtgcttttaaaacttcacagtattgccaattatcttaggttattcagtattcaggtttgtgtttctctgttttaaactaaaatgtgttttctgaagaaaaaaataatagtttacacaaatgtacaatcatagaataagcattttaagctggcgactagtgttctatagattacaaagcaagaaaactttctatgaagataaatgaccttttgcctgaagagtacagataaaatcaaagatgtgtgcaagctagtttttggaagaagtgatgcttctcttctttaaagagacagtcaccaaatacttggtttaactcgactattgacttgggcattgagagagatgatatatacatctttggaaagtgaagtcaatgttcaagaggtgatagaagctttactttttagtgatcagaaatatttagtgcatcttttcagacaggaagaattttatcatcaagtattcccttataaaaccaagtaacacttctttatcagtaacttttagaacttaaaagaaagcaaaaagtaaatggaattgtaggcaatttatgaatcctagtagattttacaatatgtaatttatgttgtttacagtatataaacactaagttttgtgttaaatgtgatcaggaataaaagtatcccacaggcatctgacacaaattccagaattagccaaagaattgtttatttgaggccaggcaatcccagcattttgggaagccaagttgggctgatctcaaactcctgacctcaggtgatccacctgcctcagcctcccaaagcgctgggattacaggcatgagccatcacacccagcgaaaagttttgtttgaataaacaatatccgaaagacaattagtttcttcagatgtattttgaaattctcctaaagagctagtgtttctattcattttcacaatttaaaaacagctcttaacattgctgaagttgggagaactttccatctcttcttaataacagtgcaagattttgtaaattcttttttgtgtttaatgtttaataaaacgagtattaagcttaaattactgaagtacctgggagaagtaatgatgtgtactttcaaaaaaatggaaaatgcttttattttattttctataatttgttaacatgatatgtaaaattaaacttcggagcacaatgaaatgccgattatttttaccttgtttgggcttaaagtaggtatttaaggtttatgtgttcaaaatgccttggtaaattggatgacctctaactttactgtccatatggagtttgtcattctttatggataagagaacttaaggaaaagttactgtttttcttcagtctttttatatctatctgatttaaaatctgttactttattaaaaggcttcaacaacaggttgttaggatgtagtcttacatccaggttcacataataaccccatttgaatccaaatttgtgtatattttcttatgccagcagtatttgtatccaattttaacttaggtttgttttcttgagtattaaaatttaaacatata

SEQ ID NO: 138861 - DNA, 2490 bp, Homo sapiens
  Payload ID: 7203
  Gene Symbol: GAS6
  Gene Name: growth arrest-specific 6
  Uniprot ID: Q14393
  ENST ID: ENST00000327773
  CDS Start-End: 148-2184
gcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaa

SEQ ID NO: 138862 - DNA, 8033 bp, Homo sapiens
  Payload ID: 7204
  Gene Symbol: GAS7
  Gene Name: growth arrest-specific 7
  Uniprot ID: O60861
  ENST ID: ENST00000323816
  CDS Start-End: 164-1414
gattttcttccctggagtgagaagcaggcagaggatcactcggtggctgtgtataccctgcctttggtggtggcaccccagtcagaaacgggaccctgaagctgggatttaggatgctggctgtgtcacctcggtctccccaagattgaacgcaagacgagccatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 138863 - DNA, 929 bp, Homo sapiens
  Payload ID: 7204
  Gene Symbol: GAS7
  Gene Name: growth arrest-specific 7
  ENST ID: ENST00000396115
  CDS Start-End: 146-691
attgcttctgggtttggggtgtgagaggatgcagagtgggagaccttaaaaccgtctgatctggctgctaaagcgagtgtctgacgaccacccattaacaccagcgagtagcgtttgctcacggctttaggataagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacagagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgact

SEQ ID NO: 138864 - DNA, 4970 bp, Homo sapiens
  Payload ID: 7204
  Gene Symbol: GAS7
  Gene Name: growth arrest-specific 7
  Uniprot ID: O60861
  ENST ID: ENST00000432992
  CDS Start-End: 162-1592
gtcccccgcctgcctgaggacccccgcgcaccccagagacggcgcgcgcccagagcgcgggagcccggagcgccgggcgcctgggaccccgcggagccgctgcccagcccgtggggctcggcgggaatgcaggctgcgctgtgaacccgggcgccaaggccatgtccggcgctcgctgccggaccctgtaccccttctccggggagcggcacggccaggggctgcgcttcgccgcgggcgagctgatcacgctgctgcaggtcccggacggcggctggtgggaaggcgagaaggaggacgggctccgtggctggttcccggcgagctacgtgcagttgctggagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgattt

SEQ ID NO: 138865 - DNA, 8003 bp, Homo sapiens
  Payload ID: 7204
  Gene Symbol: GAS7
  Gene Name: growth arrest-specific 7
  Uniprot ID: O60861
  ENST ID: ENST00000437099
  CDS Start-End: 146-1384
attgcttctgggtttggggtgtgagaggatgcagagtgggagaccttaaaaccgtctgatctggctgctaaagcgagtgtctgacgaccacccattaacaccagcgagtagcgtttgctcacggctttaggataagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 138866 - DNA, 1799 bp, Homo sapiens
  Payload ID: 7204
  Gene Symbol: GAS7
  Gene Name: growth arrest-specific 7
  Uniprot ID: O60861
  ENST ID: ENST00000542249
  CDS Start-End: 169-1407
cctctctgctcccagaggagctgtcctctgtgcaggggctctgaatgctcaggtgcttctcactgctcatgctcacgcaaccccggaggtcacgtgtgtgctgcctctgacctcaggggtttatgggccgcagacttcccaatgtcacgctactgtaggaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatca

SEQ ID NO: 138867 - DNA, 732 bp, Homo sapiens
  Payload ID: 7204
  Gene Symbol: GAS7
  Gene Name: growth arrest-specific 7
  ENST ID: ENST00000584146
  CDS Start-End: 194-732
aggaagccggcggagtcttggtgctgagtctgagggcttcaggcaggacccaagactctcctctgaggtagcagcccccagagaaggttagctgttctctgatggccaagtctctgaatctctgacctttagaagaaaatgaagactctgccggggtccagcctgtctcctgcataactactggaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaag

SEQ ID NO: 138868 - DNA, 554 bp, Homo sapiens
  Payload ID: 7204
  Gene Symbol: GAS7
  Gene Name: growth arrest-specific 7
  ENST ID: ENST00000584389
  CDS Start-End: 171-554
acagtcccctggtttcttgagcccaaccccaatgctgtaattctgtttattttgctgaatatgaaatccatatggttctgatttcttccttgtaatccgtcatctctgtgtggcttcggagccagcaaccacgcaaagtggctttgaagttgttgttctggaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctg

SEQ ID NO: 138869 - DNA, 1528 bp, Homo sapiens
  Payload ID: 7204
  Gene Symbol: GAS7
  Gene Name: growth arrest-specific 7
  Uniprot ID: O60861
  ENST ID: ENST00000579158
  CDS Start-End: 115-1353
aatgtcacgctactgtagggtgaattcatcagcctttgccttcctggtttaaaaactcttgcaaaaatgccaaatgggtgtgaccttttctttcttctccaacagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatatt

SEQ ID NO: 138870 - DNA, 544 bp, Homo sapiens
  Payload ID: 7204
  Gene Symbol: GAS7
  Gene Name: growth arrest-specific 7
  ENST ID: ENST00000580043
  CDS Start-End: 226-544
aatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaagg

SEQ ID NO: 138871 - DNA, 2417 bp, Homo sapiens
  Payload ID: 7204
  Gene Symbol: GAS7
  Gene Name: growth arrest-specific 7
  Uniprot ID: O60861
  ENST ID: ENST00000580865
  CDS Start-End: 157-1167
aattcgccttcagcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcc

SEQ ID NO: 138872 - DNA, 553 bp, Homo sapiens
  Payload ID: 7204
  Gene Symbol: GAS7
  Gene Name: growth arrest-specific 7
  ENST ID: ENST00000583882
  CDS Start-End: 157-393
aattcgccttcagcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccagg

SEQ ID NO: 138873 - DNA, 3535 bp, Homo sapiens
  Payload ID: 7204
  Gene Symbol: GAS7
  Gene Name: growth arrest-specific 7
  Uniprot ID: O60861
  ENST ID: ENST00000585266
  CDS Start-End: 312-1562
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagt

SEQ ID NO: 138874 - DNA, 556 bp, Homo sapiens
  Payload ID: 7204
  Gene Symbol: GAS7
  Gene Name: growth arrest-specific 7
  ENST ID: ENST00000578599
  CDS Start-End: 134-556
ctatatataaatgctgctttgcacagtgaattagccgatgccacggggaagcagcggatgtggggatggtggcagaaaatgaccagcgtgtcagatttgcataaggacacaccacaaggctgagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgg

SEQ ID NO: 138875 - DNA, 3185 bp, Homo sapiens
  Payload ID: 7205
  Gene Symbol: GAS8
  Gene Name: growth arrest-specific 8
  Uniprot ID: O95995
  ENST ID: ENST00000268699
  CDS Start-End: 123-1559
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgtttt

SEQ ID NO: 138876 - DNA, 3200 bp, Homo sapiens
  Payload ID: 7205
  Gene Symbol: GAS8
  Gene Name: growth arrest-specific 8
  Uniprot ID: O95995
  ENST ID: ENST00000536122
  CDS Start-End: 213-1574
gacccttccctcgcgggccgcgccccgccgcggacaccaccgggacctggctgcgccctcccgaccccggccgggcgtccggggctcctgcgcactcacttggcggccgcgcccgctggcgtcctcttgttctcttccaggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgtttt

SEQ ID NO: 138877 - DNA, 3174 bp, Homo sapiens
  Payload ID: 7205
  Gene Symbol: GAS8
  Gene Name: growth arrest-specific 8
  ENST ID: ENST00000566266
  CDS Start-End: 40-147
ctggtcccggagtcgccgctgggcctgtccgctggcgtcatggcaccgaaaaagaaagggaagaaaggcaaagccaaaggcaccccgattgtcgatgggctcgctccagaggacatgagcaaggagcagctgtttatttttaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataa

SEQ ID NO: 138878 - DNA, 550 bp, Homo sapiens
  Payload ID: 7205
  Gene Symbol: GAS8
  Gene Name: growth arrest-specific 8
  ENST ID: ENST00000563936
  CDS Start-End: 199-550
gggccgcgccccgccgcggacaccaccgggacctggctgcgccctcccgaccccggccgggcgtccggggctcctgcgcactcacttggcggccgcgcccgctggcgtcctcttgttctcttccaggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgc

SEQ ID NO: 138879 - DNA, 479 bp, Homo sapiens
  Payload ID: 7205
  Gene Symbol: GAS8
  Gene Name: growth arrest-specific 8
  ENST ID: ENST00000564392
  CDS Start-End: 194-479
gagtggggaggaggcctcttcaggaagagcagtttatttttgtgaaaggaatacttactgatttcaaacatttggaactaaactggaacgtatttttctttccgatttctgcgtttttgaggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggca

SEQ ID NO: 138880 - DNA, 1394 bp, Homo sapiens
  Payload ID: 7205
  Gene Symbol: GAS8
  Gene Name: growth arrest-specific 8
  ENST ID: ENST00000565062
  CDS Start-End: 70-405
gaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggtgctgtgcgtgggctgggctggggaggcacactctgcctgtcctagaatgtgggctgcagagtcctggggatccagaccccagctctccaccccaacacacccagtactttttataagattgtttgacaatgcccctctcatatccttaactgaaattcctaaataacgtaacctatctctacctattgttaaaagcagtcaggatattgccctcaccgtagtgcagagggggaagtaatgaagtgtgttctggtttgtaaaagctcagatggaaccgcagtgagggccgtgatgtggctggagtggataggtgtcatagtcactgcctgcgacaggtggataggtgtcatcgtcactgcatgctggcagtgacaggattttctacagtagacaacggcccttggtggaatcttgaacaaagtatagtccttcagtctgcatggaagctgcattcccag

SEQ ID NO: 138881 - DNA, 486 bp, Homo sapiens
  Payload ID: 7205
  Gene Symbol: GAS8
  Gene Name: growth arrest-specific 8
  ENST ID: ENST00000561675
  CDS Start-End: 307-486
gcggccgcgcccgctggcgtcctcttgttctcttccaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgg

SEQ ID NO: 138882 - DNA, 3308 bp, Homo sapiens
  Payload ID: 7205
  Gene Symbol: GAS8
  Gene Name: growth arrest-specific 8
  ENST ID: ENST00000620723
  CDS Start-End: 495-1682
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcagctgtttatttttaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgtttt

SEQ ID NO: 138883 - DNA, 1691 bp, Homo sapiens
  Payload ID: 7206
  Gene Symbol: GAP43
  Gene Name: growth associated protein 43
  Uniprot ID: P17677
  ENST ID: ENST00000305124
  CDS Start-End: 367-1083
tccgagaaagagacggagagagagggaagaaaaagacagatagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaa

SEQ ID NO: 138884 - DNA, 1901 bp, Homo sapiens
  Payload ID: 7206
  Gene Symbol: GAP43
  Gene Name: growth associated protein 43
  Uniprot ID: P17677
  ENST ID: ENST00000393780
  CDS Start-End: 469-1293
acagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacagaattaaaagggaacctggtctctgggttgttttcaacatctcaagtgtgaattttccctgtcaaaatcttcacaaggaaaatgagtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgatgacaaagtcctgctctgaattatgccaccccgcactccactttttaccttgcctgggaggcttgaggaaaaatcttcagagagcagttcgacctagtccttattcacttggcttcttgactttctggatttcaagggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaa

SEQ ID NO: 138885 - DNA, 2517 bp, Homo sapiens; identical to SEQ ID NO: 116699
  Payload ID: 7207
  Gene Symbol: GDF1
  Gene Name: growth differentiation factor 1
  Uniprot ID: P27539
  ENST ID: ENST00000247005
  CDS Start-End: 1347-2465

SEQ ID NO: 138886 - DNA, 2458 bp, Homo sapiens
  Payload ID: 7208
  Gene Symbol: GDF10
  Gene Name: growth differentiation factor 10
  Uniprot ID: P55107
  ENST ID: ENST00000580279
  CDS Start-End: 267-1703
gccgactcgggctcggctcggctctgcgctgctccggacggctgtgaccgctggccgggggctcgggccgccggtacccacggaccgcgcgcccgggtgcctgctccgctaagcccctcgccccgcgcggacctcggtatccagcgccctgctgcccgggctctccccgcgcgccctactgccgcgaggtcagtccgcagcctccggtgcgccagcgctcgccttcctcctcctggacttcggccctttgccgccctcaccacgccatggctcatgtccccgctcggaccagcccgggacccgggccccagctgctgctgctgctgctgccgttgtttctgctgttgctccgggatgtggccggcagccacagggcccccgcctggtccgcactgcccgcggccgccgacggcctgcagggggacagggatctccagcggcaccctggggacgcggccgccacgttgggccccagcgcccaggacatggtcgctgtccacatgcacaggctctatgagaagtacagccggcagggcgcgcggccgggagggggcaacacggtccgcagcttcagggccaggctggaagtggtcgaccagaaggccgtgtatttcttcaacctgacttccatgcaagactcggaaatgatccttacggccactttccacttctactcagagccgcctcggtggcctcgagcgctcgaggtgctatgcaagccgcgggccaagaacgcttcaggccgcccgctgcccctgggcccgcccacacgccagcacctgctcttccgcagcctctcgcagaacacggccacacaggggctactccgcggggccatggccctggcgcccccaccgcgcggcctgtggcaggccaaggacatctcccccatcgtcaaggcggcccgccgggatggcgagctgctcctctccgcccagctggattctgaggagagggacccgggggtgccccggcccagcccctatgcgccctacatcctagtctatgccaacgatctggccatctcggagcccaacagcgtggcagtgacgctgcagagatacgaccccttccctgccggagaccccgagccccgcgcagcccccaacaactcagcggacccccgcgtgcgccgagccgcgcaggccactgggcccctccaggacaacgagctgccggggctggatgagaggccgccgcgcgcccacgcacagcacttccacaagcaccagctgtggcccagccccttccgggcgctgaaaccccggccagggcgcaaagaccgcaggaagaagggccaggaggtgttcatggccgcctcgcaggtgctggactttgacgagaagacgatgcagaaagcccggaggaagcagtgggatgagccgagggtgtgctcccggaggtacctgaaggtggacttcgcagacatcggctggaatgaatggataatctcaccgaaatcttttgatgcctactactgcgcgggagcatgtgagttccccatgcctaagatcgttcgtccatccaaccatgccaccatccagagcattgtcagggctgtgggcatcatccctggcatcccagagccctgctgtgttcccgataagatgaactcccttggggtcctcttcctggatgagaatcggaatgtggttctgaaggtgtaccccaacatgtccgtggacacctgtgcctgccggtgagaccactccagggtggaaagaagccacgcccagcagagctgccttctcggagccttctgcaaccaggacttgtggtgcagctgcagacacagagcacagctcatgggcaacatcactggggcccagagagagctgtccgccagtgcatcattagggggtctttcattgctagtgactagccccttaaatgccagcctgagtacctgaaggaatctgggaattagccctggcctgaaagtggcccatcattcatacccactgttctgaaggcttgaaaacaaaacatatccacaacattggcttgatgtgatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaat

SEQ ID NO: 138887 - DNA, 8657 bp, Homo sapiens
  Payload ID: 7209
  Gene Symbol: GDF11
  Gene Name: growth differentiation factor 11
  Uniprot ID: O95390
  ENST ID: ENST00000257868
  CDS Start-End: 38-1261
tccccgccccccagtcctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagacccctagccctgcccccatccccccaagccctagagctccctccactcttcccgcgaacatcacaccgttccccgaccaagccgtgtgcaatacaacagagggaggcaggtgggaattgagggtgaggggtttgggggaaaggggaagcaggggcatagtcagggtggggagtgtttgaagtttgcagatgagaaggtttgacaaaaagacagagagatgtagagacagtgatagagacagaggaacaaaaagagcagcagtgagaaggcaaagagagaggcagaagagacagacgaggcagagacaaaacactgagaaagagactgaaatggagtaataaatgaaagccccacaccaagcctcctttcttccactggcaaggtgaggggcttggtatagtttggggagatcccctgactattcagtaggagaagaaatcaaaaatccattcttttctccttctctccctccaacagtggccaggggaaggggaagtgagggcaggggcaaaaagatttgggaatttttatttatttatttattgtgacttttcatttttttggtatttggctttactggaataggagggcccctgcccactgtgccccgtttatcccttattccccaaaccctgctctccccaacacctactcacttaagcacttgtataaagcctccagggttgggaatgggagtaaagggcaagagggcggacacatgaagtttagtttctaacccatcatcaccctaactcaaccttttctgagccaaatggcttgaattgaagccagttgtcatggaaatagtaagaggttagggtttaagagctggggatgcgggggtgggagagagaaccctcaacatccaggatctatataatgagagctactttaaaccctcaggtccaccctcatgatgctgagttatttagccagagggtgcagcctgcttatgcccaaattccctcagccaagagagagaccaaagagcctctggaatggccctgctcccagcctctatcttcaggtcaattagagagagtatagagaccccagagtcccctgggtctggaaagcgttaggagaggtcaagaaaggagcagtaaggaggctgaaggttacagggcatttgaatccaaatcactgctctgggctagggaatagagccagcagaccaaggtgggaaggattctggaagggggacattttagtctcctaaccccaaagctcagggtggaagaggggagaacaaggaagcagagtgtataattattttttccttttatttttggaatctaacagtacctggcagcagggaggggaaagtacagtggggaaaagcatctgacaaggccagttagaacagaggatgggaaggatggagactcccgggcttggaaggctaggaagcaggcagagactggttgccatttcaagtcactagctaggcccattcattcctcccacaaccctgacccattctcctctggactcactgtgcctcagtttcttcccctcaatggaatgagaaatgacagcacccgccacagccaagagatgaattctgagcacttaccacgggcactttatggacataaaatacctctcgctgtgggacagataaccagggcaccagagtagtggtgaagagatgtgaggcttaagaggagtcacaggcttcagagtacaagttcccctctgcctcccagctggacagtgcctagaagccaaggagttgagaatctcctgatccacaccctatccttacttcaccaccaggcctcttggctccaggcaagagcttagaggatgtcaggagaggtgggggtaagaatcttcagcaaaactgtcactctaagtagagccagcagttacgggtctgataaaaacagtactgaactaaagtaaagcccaagctggtgagcaaaactggatggctcattcttcccaagagcatgactctcccccttggccagttggtggaaggggcaaaggtatgtgaccacccttgagaaggtgatgttggtgagctttaacatcttattcctattcttatagtgagaaagtgaaacaagatctttcagtagaggaatgggcagggctgttaggctcttcagcttgccttcacccatatagcagctatgctaaccccaagcctctctggccctgttcttcatccttccttctgccccaatcctgaaggacaagacacacccggccatcaacaccactcacatttccttggtggaaggaaaggaacagagaagtgaagaacagatacctccctccaaggtcaaatgcctcgtgatcttggcagagtagggattgggcaataagcatcaggtatcttccctctacagattctagagagctggggcattaaatatgggggacacttagaatacagctccttaaataccaccaaataaagacctttgtgtgtgtgtggtgggtggggggggggcaggggtctttctcttatgaacataaatctgtgagctgaagtctcattcccctgttcctccctacccccaaagaggcacagagtgaagggacttggggggcacagctcagcaacccagtgggagttagcaccccctcccaccttatgatgtgtgtggacctggccagtgcccctctgaacatatcattattagtgtaattatcatttattttgtgtatttgtcacattgtgtgcatgacagcctttgttaagggtgtctgaggagtatggagctgacaggggcattggaatgccaggaaagaacttcttcaactgagatcaaggcttcctggagggaaccactgcaaaaaggccatcaggcagttttcaagttatgtgacagagggcaaagacggccatagggtgctctgagttttgggatggtcacatgacacaatccagcacttgaacctgaaaaaaaaaataaaagcggtcaaagagtttagaattcagtgctgagctcttctccctaatcaagtgccacatttacaccttggagaaccggaggtgaagaggatctgagacaggaaacctcgtgttcaatgactaagaagatggggtcctggagcaagacagaaaacactaagggcatggtggtataaggtttgggacatgcaggccaaggaaggatggaaagaggacaggaaactgggggtacctagaacaacccctctctgaaaagcttgagccaaaacagtcccaaagacaacaagacccctctcccagcctccacagaatggaagatctaaaggttctcttgagatgatccagctagtatggaagatctaaaggttctcttgagatgatccagctagtgtcctattctcctgcagtccctgttcctaggtttcctcaacgaagtttgacaaaaatctaaaccaacatagccaacgaacttgccttgttacacaagagtggctaaaatagcatctcaaatattctttcagttcactgtaaaaatttttcccatgtacctagagcacaattccccaggaatatgagttgggaatggcaaaagaatattgcctgactcacatttttcaaaaataaggaaagctggctgggcgcagtggcttacatctgtaatcccagcactttggggggccgaggcgggcggatcatgcaaggtccggagttcgagaccatgctggccaacattgtgaaacctcatctctactaaaatacccaaaattagccgggcgtggtggcgtgcgcctgtaatcccagctacatggaaggctgaggcagaagaatcgcttgaacccaggtggcggaggttgcagtgagctgagatcgcaccactgcactctagcatggtgacagagtgagactcccatctccaaaaaaaaaaaaaaaaaaaaaaaaaggaaagcaggacccagtggtgtgctcctgtagttccagctattcaggaggctgtggcaggaggaccacttgaggccagagggtcaaggctgcagtgtgctataattgggcctgtaaatagccactgtactccaagctgagcaacacagtaagacactgtctctaaaaataattaaagtaaaataaaaataaggaaagctcctgtgacatcaacctgatccagaattggggacagcgctactgcgggttcaatgtactgccatgttttccctgtcttatcagttctatcagcacactgaccccactcgagaccaactacaagactaaggctggaagtggttgagtagcagaagtgttatgtattctatcttcccaagggaaccatatccacatctacccctaactttggcctgagctgaaaatgggttttctctccctgtggctcatttgtttcctatattgagagaacacccaaaaaaagactactcaagatgactttttacaagtcttttctttatcctaaaacatcctccaaccgaaggcatgggaagctatcctatactctgaccttgcctatattttaaatggcaggggccccaagctaagaatcagcaggcagtggcatctacagcttctggtctgtagtggcgtagaagcaggaaaatcaatgctccaaagcaacaatgtccagctttcctgccagtgagctgggcttgagggagtgaatgggactctttctgccttttctttttctcaaaatacgactgcattaactgggtgtatgcacacacaaacatgttcaaactagggcactcatacctagctagaacctactcagggaaagaaatatgtatttccacagtaccctgatcacccagtaaaagctaatatttattgaataattactatgcaaattatggtaagcaaattgtagtgtgaatacatgatatgagaatatcacttaattcacacagcaaccttcacaatggggttccttttggtacagtctgaaaagagaatgattatctgcgcagggtctcagagctagtgtggtagaataagaaattaaacctaagtagttgctaaacaatattacattctaatctatcctattgaaagtgatccgggaggtagaaacctaaatacaggaataacataagggaaagagataacaagaaagttagggacaccttggactcaaagaatctggaaagatgtgaaacctgtaattttaaatccctttggaagggaaaaacaagaaaagtctagatatggcaagagaaggggaggttaaattttggggggattccaataatcagaaataagtggcattgccagaggccctcatataagagaacagcaaaaaagttatcctcccttaagttcctccctcactcctcatatcagacacagcaagagaactcagctcaacaccaagaagtcctgcccttattcacaccttccttcctatagccctcatcctcacagaagcttctagcctctatcttcagcagttcttaagaggtggggtggggggctgggcagtttagagtgagagtggaaaaaaagaataatcctagagaaccataaaaaagtacagatttacagctgaggaagctagttctccccacagcttttatagactccctcattaagagcttccaggtatgcagagaatgtcacagcttcaggaattggaatcagttaaccacatctggatgctggatcaactatagtagggaaacggggagaggaaggaagggtactaagatctcaggtaaacaattacaagcctcaatgtctgttccatctccaaacggaattactattttaaaactgaattgggaaaaaggcatcctgaactattcatgctcaaagagtatgtggagaatgactataatgagataggaaggggaggacttcatctggcttggaggttagagacttctgaccaacataggaacagctgctgaaatgggatgaaagaggttaataagaaaaaaaaaaaaatcctcacaaattggaaaacactgttcaaagatctaggggaagtaagatgagtgaggagaataattaggcttcaagaagagaatcctggcaagtaaggctgaatatctttctggaaggttatagaggataaagagacgaagaaaacttccaaaagatccactgttccacttcataatcagcatctgctctattccctcatgtatttttctctttttaaaaccatattcaggaagaaaccattagtgaatctataatctctcaagttacaaatcagatctattctgttttcagatgaaggcagagtagagagaggaaaagctagccccaagatcagagcctgaggtaaagaaaaggaaggcagacagaaaagagggaaaagggaaggtcattccaattttaaggtttatttggttgaagaggtgtcaaaaatttaaccagcattcccttttgttcacttctccaaagtctcagaatggggcaaacttcacaacaaatgggcagcagtttttggatctgctctccaaggcacaatttttctaaattatctaaactttaggtccctgctttcctcaccaaccagagactttggagaaataaagagatatcttgacattagaaaggtgatcaaactattaccatttcattaagcacaaaaccaggcaggttttagtagaaataaggataaaggattacaccacagcaacatgggacctgatcatagtaccaaagtcttcaggtaaggtgtcaggctcctaagtcttattaccaaaaatagctcaaacaaaaaccgagcttatataaagattaagaggagaaattctgcaataacatatccaaaaagattaagcaggtttcagatctacatgaacttgaagcctccagttccactgcttatgttcccaatgatttagctaacaatgcgtaacagctctgacatcctctgtcatgctttgattctgcatacaaaatttcttctgtctctgagggatatccagcccatctcccttcctgaactgactgaccaacatagtatcgtatcacatcacccttgaaatcagggcccttttcctttaatgtgggaccctggactccattttatccaagaaaaagtctgcattattagctaataacagaaggctactaatcactgcccttgtatttatatcctttgcaacacctaaaacctcccatgttctgttttatttcagtgggtcactacaagctgctggagcaaagacttggtgggtgggtaacttaacctcttcacagaggataaaaaatgcttgtgagtatgacagaagggaataaacaggcttaaagggtaaactcagtccttttccttgtcttctcttctaagggataaaggtattatggccaattctctataatatttgcccctgaagctccccttatctggtctaatctagctccaataaatcaaaggagcacctaataaaacacattgttctctttt

SEQ ID NO: 138888 - DNA, 1258 bp, Homo sapiens
  Payload ID: 7209
  Gene Symbol: GDF11
  Gene Name: growth differentiation factor 11
  ENST ID: ENST00000546799
  CDS Start-End: 1-1142
ccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaagtgggtcactacaagctgctggagcaaagacttggtgggtgggtaacttaacctcttcacagaggataaaaaatgcttgtgagtatgacagaagggaataaacaggcttaaagggt

SEQ ID NO: 138889 - DNA, 1200 bp, Homo sapiens
  Payload ID: 7210
  Gene Symbol: GDF15
  Gene Name: growth differentiation factor 15
  Uniprot ID: Q99988
  ENST ID: ENST00000252809
  CDS Start-End: 33-959
agtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggaggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 138890 - DNA, 562 bp, Homo sapiens
  Payload ID: 7210
  Gene Symbol: GDF15
  Gene Name: growth differentiation factor 15
  ENST ID: ENST00000597765
  CDS Start-End: 544-562
ggggagaagcaggcaggagaaccgagtcttggccttaactggctggcaacgtaaaacctgccctccacaaggacaagatgaaaacttggggatttggaggggacaacaaattagactcaatcacaatttcaaacttttggatgtcaatatatccatcaagaaattgaaaagaggcctggcatggtggccgatgcctgtcatcccagcactttgggagaccaacgtcggaggatcacttgaggtcaggagttccagaccagcctgggcaacactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactca

SEQ ID NO: 138891 - DNA, 890 bp, Homo sapiens
  Payload ID: 7210
  Gene Symbol: GDF15
  Gene Name: growth differentiation factor 15
  ENST ID: ENST00000595973
  CDS Start-End: 552-890
agaaagcaactagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgagggg

SEQ ID NO: 138892 - DNA, 1955 bp, Homo sapiens
  Payload ID: 7211
  Gene Symbol: GDF2
  Gene Name: growth differentiation factor 2
  Uniprot ID: Q9UK05
  ENST ID: ENST00000581492
  CDS Start-End: 180-1469
aagcacaagtggaggacaatccagcccggcagcgggtgagagtgggtgctggccaggacggttccttcagagcaaacagcagggagatgccggcccgctccttcccagctcctccccgtgcccgctaacacagcacggccgcctgcagtctcctctctgggtgattgcgcgggcctaagatgtgtcctggggcactgtgggtggccctgcccctgctgtccctgctggctggctccctacaggggaagccactgcagagctggggacgagggtctgctgggggaaacgcccacagcccactgggggtgcctggaggtgggctgcctgagcacaccttcaacctgaagatgtttctggagaacgtgaaggtggatttcctgcgcagccttaacctgagtggggtcccttcgcaggacaaaaccagggtggagccgccgcagtacatgattgacctgtacaacaggtacacgtccgataagtcgactacgccagcgtccaacattgtgcggagcttcagcatggaagatgccatctccataactgccacagaggacttccccttccagaagcacatcttgctcttcaacatctccattcctaggcatgagcagatcaccagagctgagctccgactctatgtctcctgtcaaaatcacgtggacccctctcatgacctgaaaggaagcgtggtcatttatgatgttctggatggaacagatgcctgggatagtgctacagagaccaagaccttcctggtgtcccaggacattcaggatgagggctgggagaccttggaagtgtccagcgccgtgaagcgctgggtccggtccgactccaccaagagcaaaaataagctggaagtgactgtggagagccacaggaagggctgcgacacgctggacatcagtgtccccccaggttccagaaacctgcccttctttgttgtcttctccaatgaccacagcagtgggaccaaggagaccaggctggagctgagggagatgatcagccatgaacaagagagcgtgctcaagaagctgtccaaggacggctccacagaggcaggtgagagcagtcacgaggaggacacggatggccacgtggctgcggggtcgactttagccaggcggaaaaggagcgccggggctggcagccactgtcaaaagacctccctgcgggtaaacttcgaggacatcggctgggacagctggatcattgcacccaaggagtatgaagcctacgagtgtaagggcggctgcttcttccccttggctgacgatgtgacgccgacgaaacacgctatcgtgcagaccctggtgcatctcaagttccccacaaaggtgggcaaggcctgctgtgtgcccaccaaactgagccccatctccgtcctctacaaggatgacatgggggtgcccaccctcaagtaccattacgagggcatgagcgtggcagagtgtgggtgcaggtagtatctgcctgcggggctggggaggcaggccaaaggggctccacatgagaggtcctgcatgcccctgggcacaacaaggactgattcaatctgcatgccagcctggaggaggaaagggagcctgctctccctccccacaccccacccaaagcatacaccgctgagctcaactgccagggaaggctaaggaaatggggatttgagcacaacaggaaagcctgggagggttgttgggatgcaaggaggtgatgaaaaggagacagggggaaaaataatccatagtcagcagaaaacaacagcagtgagccagaggagcacaggcgggcaggtcactgcagagactgatggaagttagagaggtggaggaggccagctcgctccaaaacccttggggagtagagggaaggagcaggccgcgtgtcacacccatcattgtatgttatttcccacaacccagttggaggggcatggcttccaatttagagac

SEQ ID NO: 138893 - DNA, 1239 bp, Homo sapiens
  Payload ID: 7212
  Gene Symbol: GDF3
  Gene Name: growth differentiation factor 3
  Uniprot ID: Q9NR23
  ENST ID: ENST00000329913
  CDS Start-End: 49-1143
cagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtcaata

SEQ ID NO: 138894 - DNA, 2383 bp, Homo sapiens
  Payload ID: 7213
  Gene Symbol: GDF5
  Gene Name: growth differentiation factor 5
  Uniprot ID: P43026
  ENST ID: ENST00000374369
  CDS Start-End: 316-1821
ttcaagccctcagtcagttgtgcaggagaaagggggcggtcggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcaccttcgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggccgccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaagccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaa

SEQ ID NO: 138895 - DNA, 2572 bp, Homo sapiens
  Payload ID: 7213
  Gene Symbol: GDF5
  Gene Name: growth differentiation factor 5
  Uniprot ID: P43026
  ENST ID: ENST00000374372
  CDS Start-End: 505-2010
cgctgccactggttagcgataatactggcagcgcgaccggtttctgagggttgttcaccttgctgctcagacgctccgagaagcttcaggcagcataacacttacagtagagacagggtttcaccatgttagccaggatggtcttgatctcctgacctcgtgatccacctgcctcggcctcccaaagtgctgggattacaggcgtgagccactgcgcctggccgcaatttacttcattgaatctccaacaagagtcctgtgagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcaccttcgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggccgccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaagccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaa

SEQ ID NO: 138896 - DNA, 1734 bp, Homo sapiens
  Payload ID: 7214
  Gene Symbol: GDF5OS
  Gene Name: growth differentiation factor 5 opposite strand
  Uniprot ID: Q5U4N7
  ENST ID: ENST00000374375
  CDS Start-End: 443-1195
agggatctattttggagacaacaaacttgactaaggaatctcaagaagaaaatataattctgctgccaggccccaatggagcaaatagagctcgggacccaggggcctttggaaggaacaggaatgcggttagaggagtgcaggaaggggctcttgggatgtgccacccaggaagacagagggccagtgctgctacctgcagccacacgactccacgaccatgtcctcatactgcttatacaccacgttgttggcagagtcaatgaagaggatgctgatgggactcagccgcgtgggcacacagcaggtgggtggtgtggactcggggtccatggagttcatcagggtctggatgactgcatgattcgtgggctccaggtgggagcgcaatgggaactcgcacagcccctcgcagtggaaagcctcgtactcaaggggtgcgatgatccagtcgtcccagcccatgtccttgaagttgacatgcagtgccttccgactgcagcgagccttaaggttcttgctgggtcgcttgccctggcgagtggccagtggggcccgccgttttcgccgctggctgaacaggtactcatacacggtcttatcgtcctggccagagcgggccttaatctcattaaagaacaggtcccgtttcttggtgcggccaaacaccaggaacagggctttctcgtggacctgccgggcggcgcggtcgaagcccaggccacggaggtccacggccctgccccgttcccaggcctccagctccaggcacagctgggccgagttcttaaagtttcggaagagcttccagatgtcgaacacctcccagccagatccgtccaggcctggcacggagcgcacatccagcaaggcggccggctgccggccgctggggcagctggacagcttcagctgggcagcccgcccgcctccgggggccgctggcttggccgtgtccgagggcttcttccgcaagatccgcagctcggcccccagcagcccatccttctccagggcactaatgtcaaacacgtacctctgcttcctgaccacgggacctcggtcatctagagagaacacccagaagtcattccctgcaacctcaccaagggagccagtcacttcgaggctgcgggggaaggccccagctctctcccagtccagagagctttctttcacctctgccccattctgacagaagccaagagccaaaccactgagagcctttttgaaaatgagagcatttcctacatagccgaccaagtaggggtgttcacctgaagatgtggctggggatgatttgcgtgattctggtgtttgtgtcatgatatacgtgttatcagagatttatcagctttgtaactgccttctacctatctctctcccagccatgagctaacgtgatgtctcatttgtgagataggtggagtgagcattaaaattactcctgttgactgggcacagtggctcacacctgcaatcccagcactttgggaggctgaggtgggtggattgcttgagctccggagttcgaaaccagcctgcacaacatggtgacactctgtctctacaaaaaatacaaaaattaaccaggcatggtggcgtgcacatgtagtcccagctactcaggaggctgaggtgggaggattgattgaccccagggaggtcaaggcttcagtgagccgtgaattcgctattgcactccggcctgggcaacagagaaagaccctggct

SEQ ID NO: 138897 - DNA, 3701 bp, Homo sapiens
  Payload ID: 7215
  Gene Symbol: GDF6
  Gene Name: growth differentiation factor 6
  Uniprot ID: Q6KF10
  ENST ID: ENST00000287020
  CDS Start-End: 101-1468
cccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacgagtacatgctgtcaatctacaggacttactccatcgctgagaagctgggcatcaatgccagctttttccagtcttccaagtcggctaatacgatcaccagctttgtagacaggggactagacgatctctcgcacactcctctccggagacagaagtatttgtttgatgtgtccatgctctcagacaaagaagagctggtgggcgcggagctgcggctctttcgccaggcgccctcagcgccctgggggccaccagccgggccgctccacgtgcagctcttcccttgcctttcgcccctactgctggacgcgcggaccctggacccgcagggggcgccgccggccggctgggaagtcttcgacgtgtggcagggcctgcgccaccagccctggaagcagctgtgcttggagctgcgggccgcatggggcgagctggacgccggggaggccgaggcgcgcgcgcggggaccccagcaaccgccgcccccggacctgcggagtctgggcttcggccggagggtgcggcctccccaggagcgggccctgctggtggtattcaccagatcccagcgcaagaacctgttcgcagagatgcgcgagcagctgggctcggccgaggctgcgggcccgggcgcgggcgccgaggggtcgtggccgccgccgtcgggcgccccggatgccaggccttggctgccctcgcccggccgccggcggcggcgcacggccttcgccagtcgccatggcaagcggcacggcaagaagtccaggctacgctgcagcaagaagcccctgcacgtgaacttcaaggagctgggctgggacgactggattatcgcgcccctggagtacgaggcctatcactgcgagggtgtatgcgacttcccgctgcgctcgcacctggagcccaccaaccacgccatcatccagacgctgatgaactccatggaccccggctccaccccgcccagctgctgcgtgcccaccaaattgactcccatcagcattctatacatcgacgcgggcaataatgtggtctacaagcagtacgaggacatggtggtggagtcgtgcggctgcaggtagcggtgcctttcccgccgccttggcccggaaccaaggtgggccaaggtccgccttgcaggggaggcctggctgcagagaggcggaggaggaagctggcgctgggggaggctgagggtgagggaacagcctggatgtgagagccggtgggagagaagggagcgcagccttcccagtaacttctacctgccagcccagagggaaatatggattttcacaccttgcctggccaccctggaaaaacaagccaaggaggatttcttttgttctgttttctctctctctctctctctctctctctctctctctctctctctctctattactgtggctttggatttccttatgtgtcttacaggctttgatagaaggggaggggaggagagatgcatacccgtttctcaactgctccatggattgaaaaaataacagtttaaaaagggaaacaatgtgggaggaagaatcaccgttgacgcatcttgatttggttggtttttacatgtgtaaagaaggtggggtctctggccatgtcatagcccatgtcttgtgccctcccacacagaaagtgttagatagggaaattggcaaaaagaatagttaagtcaggaatggtcctgcctatagaagagctttgagagaggtgggcccacgggtgcccctctcacccatttgtgtactctgtgagtttaccagctctgccctggcctctttcggtaccaggaactggcaaccttcatctcactcctgagggcccaggtctctgccttcattgttgctttttctggtgggggcaaggggagctggtatggatggaatgacaagaattagtccaaatggaaccccttgaaggataatgagaaaccacaaggcctgcctctgactggggctgacacggaggtgcattagcccaggctggaggtagcccacccaaatgccctttctgattctaattgatttctttcaacagaatttgccaaaattcagacatgcacttctaaggggaaggtgattttccagttcaaaaaaatgggcaggagtggggaacaaaacaattaacgtaagagctacaaaggagggaaaaggaaccaagaagtagaaggagtcccatcaggagggaagatggtgggcctcagggaggatggggatcaagggacaggccaggagccaggagtggggaagggagggatgaaaggggacacaagtccctgtctctgaagtttctttaaaatctgagttccctcccctctctttgacattcctgaaagattaccagccagcaatagcccagggctcccccaaaagaattggttcagattgtaattatcagttaggcaatgtttttaaaacttagtaatgagaaactgtgaaaagagccaagtgttacattgagcttggggtgggagatggggaacaggcagtgaggaaggagacaggggtggaattcgtcttctgggaggaagctggagagagcacagtgaaattgaaatacccattcccagatagtcaaaaacatgaactttcccccagcctgcaccagtattgttttcaaacattgcccatgagtaggccctttgaagagttagcttcctcctcatctttgactataaaattgtttaatcaatggaatttgtaccagccttttaaaaagttttagtttttcctaagtgattttgctctcttccaatctaaacctgttgcttgtttggttcagagaactacaaactgtcaaagaaagggtggggatgataagaaatgctaatataaaaatgctaagtgaaaaaaagacttggccaggagaaataatttaaaatgcacatttgctttggatgcactgttgttctgttaaggctgtatatatttgtttatttaaggtgactgaaagtgcaaagaggaaatggacagcatgcaattcatcctaatgtacaaaacgttatatgcactcaaatgttataatttctaatatttttaaagtttatattcgagttgtacaaagttaagcattaatcagatatttcattttttcataatgttaccattttcttaaatattattacaaaattttaagtctgtctaatggagagttttttttaaactgtctacctcatataatacaagtatttacaacgctaaagttaccagaggtcaatgaataatcaaaacattttttacagtacacctttcctggatgatatgcaatcgaatgctatattattaaacgcatttttctccttaataa

SEQ ID NO: 138898 - DNA, 973 bp, Homo sapiens
  Payload ID: 7215
  Gene Symbol: GDF6
  Gene Name: growth differentiation factor 6
  ENST ID: ENST00000620978
  CDS Start-End: 28-843
ctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacgagtacatgctgtcaatctacaggacttactccatcgctgagaagctgggcatcaatgccagctttttccagtcttccaagtcggctaatacgatcaccagctttgtagacaggggactagacgatctctcgcacactcctctccggagacagaagtatttgtttgatgtgtccatgctctcagacaaagaagagctggtgggcgcggagctgcggctctttcgccaggcgccctcagcgccctgggggccaccagccgggccgctccacgtgcagctcttcccttgcctttcgcccctactgctggacgcgcggaccctggacccgcagggggcgccgccggccggctgggaagtcttcgacgtgtggcagggcctgcgccaccagccctggaagcagctgtgcttggagctgcgggccgcccccggacctgcggagtctgggcttcggccggagggtgcggcctccccaggagcgggccctgctggtggtattcaccagatcccagctgctgcgtgcccaccaaattgactcccatcagcattctatacatcgacgcgggcaataatgtggtctacaagcagtacgaggacatggtggtggagtcgtgcggctgcaggtagcggtgcctttcccgccgccttggcccggaaccaaggtg

SEQ ID NO: 138899 - DNA, 1179 bp, Homo sapiens
  Payload ID: 7215
  Gene Symbol: GDF6
  Gene Name: growth differentiation factor 6
  ENST ID: ENST00000621429
  CDS Start-End: 25-1086
gggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacgagtacatgctgtcaatctacaggacttactccatcgctgagaagctgggcatcaatgccagctttttccagtcttccaagtcggctaatacgatcaccagctttgtagacaggggactagacgatctctcgcacactcctctccggagacagaagtatttgtttgatgtgtccatgctctcagacaaagaagagctggtgggcgcggagctgcggctctttcgccaggcgccctcagcgccctgggggccaccagccgggccgctccacgtgcagctcttcccttgcctttcgcccctactgctggacgcgcggaccctggacccgcagggggcgccgccggccggctgggaagtcttcgacgtgtggcagggcctgcgccaccagccctggaagcagctgtgcttggagctgcgggccgcatggggcgagctggacgccggggaggccgaggcgcgcgcgcggggaccccagcaaccgccgcccccggacctgcggagtctgggcttcggccggagggtgcggcctccccaggagcgggccctgctggtggtattcaccagatcccagcgcaagaacctgttcgcagctggagtacgaggcctatcactgcgagggtgtatgcgacttcccgctgcgctcgcacctggagcccaccaaccacgccatcatccagacgctgatgaactccatggaccccggctccaccccgcccagctgctgcgtgcccaccaaattgactcccatcagcattctatacatcgacgcgggcaataatgtggtctacaagcagtacgaggacatggtggtggagtcgtgcggctgcaggtagcggtgcctttcccgccgccttggcccggaaccaaggtg

SEQ ID NO: 138900 - DNA, 9749 bp, Homo sapiens
  Payload ID: 7216
  Gene Symbol: GDF7
  Gene Name: growth differentiation factor 7
  Uniprot ID: Q7Z4P5
  ENST ID: ENST00000272224
  CDS Start-End: 577-1929
ctttgaggccgccgggagcatcctgtggcctctctctgcgcggccacccggccgcggcgcgaagcggtctggagggcgagcccttccgcggccccaactctgccgccccgttcccggcattgggaaccagggcagggagggggcgggtgtttctctgcgggggagtggggaggaagctgggcgggtgcgcgcggtgccccgagcctggaaccacggagggcgcgttggtcttgggcggatggagggggtgtcgcactgccgcggggaggcgtgtcgggaggctggggccagtggcagtcgcttggcgagggtgggggcgtagcgctgcggtgggaggaggcggctccggccctggtctccactctaggccggggtggggggcgcatagcggccgccggagctttcagcagggggcgctgctccgggcgttgggcgggggtggggtgggccaggagggggggccgcgggctggccgcgcacacttcccccattattaaacactatgttcaaaaggcgccgggggacttcccggagccacggagcccgcgccgcccgcccgcccggcccacggagcccatggacctgagcgccgccgccgcgctgtgcctttggctgctgagcgcctgccgcccccgcgacgggctggaagcggccgccgtgctgcgagcggcgggggctgggccggtccggagcccagggggcggcggcggcggcggcggcggcgggcggactcttgcccaggctgcgggcgccgcggctgtcccggccgccgcggttccccgggcccgcgccgcgcgccgcgccgcgggctccggcttcaggaacggctcggtggtgccgcaccacttcatgatgtcgctttaccggagcctggccgggagggctccggccggggcagccgctgtctccgcctcgggccatggtcgcgcggacacgatcaccggcttcacagaccaggcgacccaagacgaatcggcagccgaaacaggccagagcttcctgttcgacgtgtccagccttaacgacgcagacgaggtggtgggtgccgagctgcgcgtgctgcgccggggatctccagagtcgggcccaggcagctggacttctccgccgttgctgctgctgtccacgtgcccgggcgccgcccgagcgccacgcctgctgtactcgcgggcagctgagcccctagtcggtcagcgctgggaggcgttcgacgtggcggacgccatgaggcgccaccgtcgtgaaccgcgccccccccgcgcgttctgcctcttgctgcgcgcagtggcaggcccggtgccgagcccgttggcactgcggcggctgggcttcggctggccgggcggagggggctctgcggcagaggagcgcgcggtgctagtcgtctcctcccgcacgcagaggaaagagagcttattccgggagatccgcgcccaggcccgcgcgctcggggccgctctggcctcagagccgctgcccgacccaggaaccggcaccgcgtcgccaagggcagtcattggcggccgcagacggaggaggacggcgttggccgggacgcggacagcgcagggcagcggcgggggcgcgggccggggccacgggcgcaggggccggagccgctgcagccgcaagccgttgcacgtggacttcaaggagctcggctgggacgactggatcatcgcgccgctggactacgaggcgtaccactgcgagggcctttgcgacttccctttgcgttcgcacctcgagcccaccaaccatgccatcattcagacgctgctcaactccatggcaccagacgcggcgccggcctcctgctgtgtgccagcgcgcctcagccccatcagcatcctctacatcgacgccgccaacaacgttgtctacaagcaatacgaggacatggtggtggaggcctgcggctgcaggtagcgcgagggccggggagggggcagccacgcggccgaggatccccagctgatgagcagcagcgggccaccctgtcaccgagcgtgggtgcatgtccgatgtgacccagcaccctctcagaggagggagagcacacgttcacactcacacacactcgtgcagtcacgcacacatttaccggggacagcatgtgaaagccttgggaagagatgacctgccggtaccgaatgtcaaagccctgtgtattttgcaaacagataaccatggcgcccactgcccccatttagggagaggaaggtgtttgtgctgatgttgcagttagaggcacgaaaatcaggtagcaacaacgggttaggaaattcgaagttccagaatgggagaaccaaaggggtactcgagcatgctttatctcacccccttttgtttctggcccgatgtggggcatcgcttccctggggggctgagcgccgcgtggtgcactccgtgacccactgcaaggctgtaatgcccttcccgagggtttgtgttgcatggggccgtttaccctggaactgctgcaaaaagcatctttctttttttaacttttaaaatttaacgtgcccctgcttcatttttgaaagggaagttttgtctgaaagtagctgttgtggagcttcccagatttctgcaaaggtcggtaccgccacccccccccccccccccgccttttttttttttttttttaatcaattccaataggaaatgttatggaaagtggaaaggatatttttcttttaaacggctgagtctgatctaacaggatattggggtgggataggatctgccaggttcggaagctccccagttggtcagggggaggtgggagccatgcctcgggtggctcaggaggaagttagtgcaatggcccggaatggggaaggtggggctgggggaggggagctactgcttttcctagagacctgccaggaggttttcctaagaagccagggaagaggctctcagggcttgaaaggcaaggaggtgtcctggggcccactccagccgaggactccggcttgccggccaggtaggcggaagctcccggggccgactcgggcttgtgctagttatcaagtaagtcggcctccgctttttacctgctttcgctgtgttgttgctgtagttgttggcagtgtgatagtaacgggaagtgaagccactcaaaaatgcttttgtcagacttcaactcacaacccagacctttagagcagggggaaggtctgccccttcccctcatcggctccctggcttggctgctgtgcccttggaagggcagggccttggtgtgggggagcagaggtggaatatcccccagttcccttatttggccccaaagggtcttattgatgggaggattttctaggcatgtaaaagtgagttcgaacattcagacttcactgtttgatttgatttgtttatgcctgggaatcctttgtggctttttgtcaataggctgggagagggaacctagttggactccagctgtccggggtgggggcttcttagaacagccccgcagccctctcggtgcatctgtgtgatgttgtgtaggactttccccttcagagtcctggggagcattatttccaccctgtgttggatgcaggacaattcatacacattttgattctcagtgattacactcttgagagagagaagacagacttacgatttagatacagctaatttacttaggggccctacctgaatcggttttcatcctgtaaaattctcccaaaagaaaaaaaaatacacgtgtaaattactcttaaaattaagattccccccttcctcctattatgtgaatttatattctgtggctgtatgagtagctataaataaccagaacatgaacagtctcttcaggttaaaaattttaaaaatatccaaaagtggctgctctggtacaattccatcttattttagtgactgggcaaagatggtccctaaatttgtggattttgccagagatgcctcactctcgtttttaaaatgaagcttgtcataatgaagaattatatattaaaaaaagcactgaagtgttgaaagttgtagtattagaaggtttagaaaggaagttaatgacaaagtgcagttaaatgttattttgaggaaggtctggggtatttaatatctttggataaaagcaaacattttgatacttttttagtgactagtaaaaacaattttttgggcagaaatgtcttgatttagcctggcctttttatagtagggaaaaaaactgtcaatttcccctctttccttctgatgacctccttctaacgagatgtgttgtgagtggtgtgggaagtaggtaccttcctgcatcttgagttcaggtggcacccggtgggaggggtgttgtccttggacagtgactgttccttccatggccccataccctcagtgtgctctttgtttactggataaaaggaatgcttcccagatttcctctggagcaggtgaagcccccaggggccactctgcccagccctctggcatctcagtccattcactaggtgaatgcagaggatccatttcacttgtaaaaatgacaacaaagggccaacacatgtggggcagacggctttttgctgctaagatgtggtttaactagcattgccaaggtgtggagaaaagcgttctgccagcacagttggtagtagcaccctgagctctctgtcttctaggtagcgggggacaggcctgggtgactggcatgaacccagcttctctgttgcaacccccagctggaatctccagtcaccatggatgggagaactgacaggcagggagaaagcatgtcaagactgtgaggaaaggctgtcccctcaaccccaacctgaggtcaccaaagtctccctcctaaagtaaacagaattttccattttgtagggagaattgtgcactactagttgacatcacttgaaccaggatttcctgctagtgagtaggatttggcatccctacttagggagctcgggacaggccagctggggcccaacgggggctggtgctgggtctgtcaaacacaatgatagcctggtcactgctgcttgaaaccagggctttcgtattaaggaggatcacccacactggcaggcgggcatttccactgattcccaaacacacttgccttgttgaattctgactttccaaacagccgcactgggtcttccagagaaggtggcaggctttgctgtgttagcttggggaagccaggcttgagctgtgctcagtcattgtatccatgctccccttcaccataccctcctggcaacgatatgaggtgtggattgtgtgatagaagaatccagactccacgaagccaaggacagtcacttctccctggcagctctcatggtgtcggcaggagtgggcgcctcaccttgggtactgaagagagtaccgataatcccgtggatggaacaggagggagtgtaattcaatccctacacattgtatatgctgttggcaatttcatttaaactcacagcagaaaacaaccaggatttgtagactgattttcttcttagagcagggagaaaaattacgttctttccaagagcagctcgtgcacagataaggtcagacttttcctgtgcttgaatctggtctccaggaaatccagtggcaggaagagagtgtcctgaggctgcctctgggggcacagaatcactgggcctcgctgattctcatgagaacctgtcatctcagtgagacaggcctcccactggccctcagtgggccataggccaagaggtctgagtcagatcgcgcagtgagctggagggagcgaggctctgaaagcagcagtctagcagagggagtttgggcctgcgcttacccctcagaaagtgtctggattgggaagggaagagaggaagctgccgagcgaacccagcagccaaactttgggtgagtggaaagtaactagatccctctggtggatggtatatttgagctgcaccagagtcagagcccactgtgggcttccgagtgcccagaggcagctgctcccacagcacggactgcgcccgccaggggaggccgctcaggggccagggcaccacaaggcgtctcctgagagacgtctgaggcaagttatgggcagtcacctccctgctggagcttcatcttctgccctgtaaaatgatgccctttccagttccaaggttctaggattttaccttgcctcaaaacccactcagatagcttgaaggcagagcaaatgtgatggctcctggagaaggtcctctcccaatcccagtcccagagcctcatcttaccggtttcgcagctcttgcctgtgcatgtgcatgtgtgtgcgtgtgtccattttactcctatccttaataggtgcctcatggatgtgctttgaattcccctgggctgaggtaggtgtggggagggcccgcaccttgagggtggggttcagctccccagagccaggagctggctgagggcactgcccatccagctgcagttcctcctgtgctcagtggggtgggcggagccacactcaagctgagactgtctgagagacctagtgctgggaagggctctacctgctgctggggcctctgcaggcagaagggtaaaggcaaggctgtgcctggttggtcacccaaacgggggcctgggactgtcccagaagccctggatgaggcaggcaggactgtcccagaatggactccttgggtcctcaccccctcctcaccaccatgcccatgtctggctctgaggtccccttgcagcttcccaggggagtgaccctggggtagcatcagaagagcttgtctctctcttcctttttgtggtctggagaagttaacataaagaagcaccagaagggaggacccaaaaagatgtttatttctaagttttcagacagcttggcatcttgtacctggaacctcctgaccatgtaggctgcagcacagctgtcttcctccctctgtgctgttctggactttaatctgtgtgcacagcttagtgcgtcacaaatagtaactgagtgaggctgttgtgaaagaagcctgtttttttcaggagggccaccgtcctagcctgaggagacacctggtggacacagactgcagggagagggctgaaagttggcctagtgaatcagaggggtgactgagggcctagaagttgccgcgtgagctctgatcatcattaggggtgctgtctgcccatgacctgcaggtacccaccttaaccagagcttggcttgtggcctgcaacttggcgacaggcctttggctgggcaaagtttgggctggtgcttcatggcggcaggaccaattacagcagagcaacccaggatgggtggtcattgaaaaatgggtgtgaagtcactgaaaaatcagactgagtttcaagttatgctcacagttgctgaaaaagcaaaaatatgcccttagagcagcagagcagcgtgcgatggtccacttcctcctgcctctgcagagcttgcaggcctcttctagcatctgtgcatggtgcgcatgtgtctgtgacaacagaaagggtgggtttctctcacacgtttccctgacagtggcaagggggctgcagcggtcacagaaacttccggagagaggtgtttctgtgcagtcaggtgaatttgttggcaggacagcttggtgtgatgatacaagaagtacagtttcactctttttttgtcagatgaacttccttctgctagtttagaaatgcttcactccagagagggccacctgatagaagctgtattacagaaacttttaatctcttttctatgtcagtaaggggatgctgaaataaactgtctagaaaaacaagaagcttctgtcacacccaggccactttcggcagagtggtccagagcggccagggcacggccagctgctttgcatctgcattcccgtttcattaccttttgtgttgtgggccaacaggagtgctacgtagtgggggctggagatttgtccaggcaggaggtgggcaagtggctgtcttctctgcagaatacctgcactgctccatctgaccagcagtggcaacagccacaaccagttctgcatctagctcctgcccagacctttggctgccagaatctagaaccatggctgaccaaagcgagacttccgagtaaggttcgttaacaggcatcctgctgaattagaaggaaacaggaacgaatccaaagcaaacggggctaaacttccctcgaggacatttcctgagctgcaacatgggaagcgacagcaccgaagctggtgagctggtgcaactgcacacaccttttctctggtttttagtactcacaggtcatcctggggagaccgctcatgggctatgggcagcccatgcctggattttttggtgaatgagtctgaaaagcagtgaccaggtgtgttgagggcctccccttgcctgcacctttttatctctgagtgactgagggctgccaaggccagacaacgcacatgtgtcctggatcctcccctggcctggggcagcagcagcagcagcagctgggcttggggtgagtaggctggcttgaggaaggggctgcccacaagcagggctcatttcctgggtcagggcctgtcagactcaaagtcagctcttcagcattctgtttagaaaatgatgatgcagttcagtgagaaagaaagctcaggataaaatatgttttctggaggggaaatactcaagtgttctaagccaggaacagagactctcaagagaggaattctctggcattctctgccttggataaatcatggattaaacatgagcatccttagaataattttatttttgtatttcactttacactgtaatgcaaacagcttttatgttttctttgacgaagaatcataattgagtcactttaggtcttttagctggaagcatttcaccctaaatgaaaagttaatgcattttttacaaggattaacatgctaactacaacttgccctttcagcagatgacaataagggattctgaaaagtttggactgtctttttctttttgtatacaaataaagcagcagatcctttctctgtgaaggttgttgcagagctcccgtaccagcttataaaatgcggctgtttaagcaggacttgggtgggcagcagaattctgcacatgacgagtggctgcagcttagaaagcaaatttcatctgattccagtactgtgattttaaggaaacggtaaaactcaaagtgccagtaatgccatcaaggctcagtaacatgccatttcctcagcagctaaagacaaaaagaattattttggtgaggggatagaaatcctttcgctttgcagtgacacccactttttcttagcttggcttgggagtaaggagattggagtgtggggggacattagaaactcatttaaggcaaactgaaatctccttcatcagcagtcttcctgctggtgtagccacagcagaactccgaggcttgcaggctgggctgtctccttgctgcctggcttgggtgtttatttgggcaatgcaagctgacattgtgaggtgttgccgatgcccaggccagctagcagggagccctcccagggctggtagaaacctatgtgtatatatattctcaaatttaaatagattgtacatagtgaaatgtaaatgacatgtaaaacagcaatctctatttttcttaactattatatagcagtatatatttgttgaacatgcttgtatactcttcattaaccattttaatattttgtacagataagttgattaaatattttattcataaaacc

SEQ ID NO: 138901 - DNA, 1796 bp, Homo sapiens
  Payload ID: 7217
  Gene Symbol: GDF9
  Gene Name: growth differentiation factor 9
  ENST ID: ENST00000296875
  CDS Start-End: 291-1391
ggaacaaaaaggtgacgaggaaggggcctgccgacctccggggcagcgctggccaggagcttggggcctgcgagtcttcccagctgtagacagagcgcctctgagccccgaggccgggccgccccacagcagaggagcacgagcctggtctcagctccaaggcaagaacagaaatacagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcat

SEQ ID NO: 138902 - DNA, 2640 bp, Homo sapiens
  Payload ID: 7217
  Gene Symbol: GDF9
  Gene Name: growth differentiation factor 9
  Uniprot ID: O60383
  ENST ID: ENST00000378673
  CDS Start-End: 868-2232
tttccggcaaggttggaagccgctcttggaggtcgtgagcatctgcaaacatcccaaaacctttcaaccaaaatatgtatagatgagtgtgcagaccaaagtaaggacatcagtatgttacatttaaaaataagtcaaggttaaaggcggtgtcctcttttaagaacatcgcaaatacaattccagtactccaagtacgtattctgtacccagccacctgggaggactgagagacctaatggttttctgctttctggaacttctatgccaattgtgactttctcacccaaatttgtaaattcgcaaattaacatgcagcgaataattacaattgtaaacacctggaagtggaaaaggccgtgaggataaattgagaggaagagtaaacctaataccataagttgcataccagcagatctgagtatcgtcatgaataattggttagcttttccacatgccttagaagtttcagcaagcacctagcgaacatcttaatccaaatttctcaaaaaatgagagattttatttaagatcattcctcaatttatcttagactttcagctacatagttagtccggtagtgtaacagtaacgggttttacgtaaatgccaggggaaaagagaggaaagctaaataaccaagtaaatctgtatctaattaacaaattggctaaataaggtgttatcagctgcttgatatagagctgataaaatcttcagctaggcatacttgaggcctgattacagaagtgaccgtagtccacccacacacctgaaatttatttaagagaccaagctaggctcttcctggcctttaggaagaggactggcatggagaaatatgttcctcactagttctcccaagccatggcacgtcccaacaaattcctcctttggttttgctgctttgcctggctgtgttttcctattagccttggttctcaggcttctgggggagaagctcagattgctgctagtgctgagttggaatctggggctatgccttggtccttgctgcagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcataaa

SEQ ID NO: 138903 - DNA, 1939 bp, Homo sapiens
  Payload ID: 7217
  Gene Symbol: GDF9
  Gene Name: growth differentiation factor 9
  ENST ID: ENST00000621295
  CDS Start-End: 434-1534
cattgtggcggcggccctgcaggaccgagggtggacaggcgcttggctcgctttcgcgaagcgccgcagtccccgcgggggtccatccccaaccccagactcctgcccctgcactccttatcctttcccagcccagcggggcgcccctagcctcccagggtccacgaacactgcacaaccagaccccactcacgcacagggctcagctcgccctccacagtcaccgatccggttgactcgttcgtcatttccggcaaggttggaagccgctcttggaggtcgtgagcctggtctcagctccaaggcaagaacagaaatacagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcat

SEQ ID NO: 138904 - DNA, 1823 bp, Homo sapiens
  Payload ID: 7217
  Gene Symbol: GDF9
  Gene Name: growth differentiation factor 9
  ENST ID: ENST00000624492
  CDS Start-End: 318-1418
cattgtggcggcggccctgcaggaccgagggtggacaggcgcttggctcgctttcgcgaagcgccgcagtccccgcgggggtccatccccaaccccagactcctgcccctgcactccttatcctttcccagcccagcggggcgcccctagcctcccagggtccacgaacactgcacaaccagaccccactcacgcacagggctcagctcgccctccacagtcaccgatccggttgactcgttcgtcatttccggcaaggttggaagccgctcttggaggtcgtgaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcat

SEQ ID NO: 138905 - DNA, 1799 bp, Homo sapiens
  Payload ID: 7217
  Gene Symbol: GDF9
  Gene Name: growth differentiation factor 9
  ENST ID: ENST00000624495
  CDS Start-End: 294-1394
attttcctactgtctctaagggatgacgcctttgtcccagaaagaagtgggctgactgggtgacccgtactgcacaaactggcttcgtatcttgcactatgagtgtaggctgactcttccagcatagtctccttcggggtggcgctgaatatcccctcatttcagcttttcatggtgctcctttgcctcatttttttaaaccataatgtctagcctggtctcagctccaaggcaagaacagaaatacaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcat

SEQ ID NO: 138906 - DNA, 2784 bp, Homo sapiens
  Payload ID: 7218
  Gene Symbol: GFI1
  Gene Name: growth factor independent 1 transcription repressor
  Uniprot ID: Q99684
  ENST ID: ENST00000294702
  CDS Start-End: 251-1519
gagggtgcgcccaccggtcccgccgggcgcccgcgggacgcgccgccagggccctctccgccgggggctcggcgctcgcccacctcttccaaatttaaccattacctaaatccgaagggaaatgagcaaacctctcggattgggtgtcaaggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagta

SEQ ID NO: 138907 - DNA, 2855 bp, Homo sapiens
  Payload ID: 7218
  Gene Symbol: GFI1
  Gene Name: growth factor independent 1 transcription repressor
  Uniprot ID: Q99684
  ENST ID: ENST00000370332
  CDS Start-End: 320-1588
agctgagttggggtaacccacccgatgggaactacagctctccagggagtttgattgccggagcgagcttcgctaggaaaggggaggagctggggggcgtgggcagggaggaggaaaggggcctgagacagggccccgggacaggttttaccgctgagctgtgtcagtggcggcggcggcaacgacggcgggttcgcgccacctgtccaagtgccacctggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagtatt

SEQ ID NO: 138908 - DNA, 2693 bp, Homo sapiens
  Payload ID: 7218
  Gene Symbol: GFI1
  Gene Name: growth factor independent 1 transcription repressor
  Uniprot ID: Q99684
  ENST ID: ENST00000427103
  CDS Start-End: 158-1426
aaagcaagattccgtttgaaaactctcctagcgcggtgcccgcgccgtgactccgcaggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagtatt

SEQ ID NO: 138909 - DNA, 2449 bp, Homo sapiens
  Payload ID: 7219
  Gene Symbol: GFI1B
  Gene Name: growth factor independent 1B transcription repressor
  Uniprot ID: Q5VTD9
  ENST ID: ENST00000339463
  CDS Start-End: 820-1812
tgcgaggctgagtatgatgggctccatccagcacgaacacaaagccctgtgagaggaggcagagtgagatgaagtcgaactgtgggatatgaaaggcattttgaaggagtaggcatcaggctggtttttgttcgaggaaagctactcaggagcttgggaggattgcttgagaccaggagttcaagaccagcctgggctacagagcaagaccccatctttttgaaacttcctgcaactcgcatctggaaaagtgctgttatttgaaagggtgccgacattgtgaaaaacacggagtattgatctctgaagctgagatttttgtcctaaagaatactcaagatgtgtccctggctgggcacagcagctcgtgcctgtaatcccagcactttgggaggctgaggcaggaggatcgcttgaggccaggagttcaagaccagcctattgtgaatagtaccactataaatagagaaagcgtgccgctccaagtgtcgagggttagaaatgagaattcgaagtcttgtgtcctggaaagttttgataagcaaatacggctgagctcccgcgctctcttcattggctgcttgttcaccgccagattttgacacaaataatcagattgaaaatcagggaggggaacagaagaggaaaaacacacagagagacagagcaaaaaggagaagtatctatttgtgcaaagagtcacacagttgacagagtggaggccagtcccgagagaggctttgcagttcccacctcgggaagctccggcagaacccaggcgagggacagctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacaga

SEQ ID NO: 138910 - DNA, 1797 bp, Homo sapiens
  Payload ID: 7219
  Gene Symbol: GFI1B
  Gene Name: growth factor independent 1B transcription repressor
  Uniprot ID: Q5VTD9
  ENST ID: ENST00000372122
  CDS Start-End: 168-1160
cacagagagacagagcaaaaaggagaagtatctatttgtgcaaagagtcacacagttgacagagtggaggccagtcccgagagaggctttgcagttcccacctcgggaagctccggcagaacccaggcgagggacagctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacaga

SEQ ID NO: 138911 - DNA, 1514 bp, Homo sapiens
  Payload ID: 7219
  Gene Symbol: GFI1B
  Gene Name: growth factor independent 1B transcription repressor
  Uniprot ID: Q5VTD9
  ENST ID: ENST00000372123
  CDS Start-End: 23-877
aggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacaga

SEQ ID NO: 138912 - DNA, 5032 bp, Homo sapiens
  Payload ID: 7220
  Gene Symbol: GRB10
  Gene Name: growth factor receptor-bound protein 10
  Uniprot ID: Q13322
  ENST ID: ENST00000335866
  CDS Start-End: 533-2143
ggggaggtcgggaggaggcagagagggaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 138913 - DNA, 2050 bp, Homo sapiens
  Payload ID: 7220
  Gene Symbol: GRB10
  Gene Name: growth factor receptor-bound protein 10
  Uniprot ID: Q13322
  ENST ID: ENST00000357271
  CDS Start-End: 32-1678
aaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 138914 - DNA, 4785 bp, Homo sapiens
  Payload ID: 7220
  Gene Symbol: GRB10
  Gene Name: growth factor receptor-bound protein 10
  Uniprot ID: Q13322
  ENST ID: ENST00000398810
  CDS Start-End: 286-1896
cgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 138915 - DNA, 4705 bp, Homo sapiens
  Payload ID: 7220
  Gene Symbol: GRB10
  Gene Name: growth factor receptor-bound protein 10
  Uniprot ID: Q13322
  ENST ID: ENST00000398812
  CDS Start-End: 32-1816
aaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 138916 - DNA, 2279 bp, Homo sapiens
  Payload ID: 7220
  Gene Symbol: GRB10
  Gene Name: growth factor receptor-bound protein 10
  Uniprot ID: Q13322
  ENST ID: ENST00000407526
  CDS Start-End: 297-1907
cagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 138917 - DNA, 4760 bp, Homo sapiens
  Payload ID: 7220
  Gene Symbol: GRB10
  Gene Name: growth factor receptor-bound protein 10
  Uniprot ID: Q13322
  ENST ID: ENST00000402578
  CDS Start-End: 266-1876
accgactctgtgaattgggtaccttcatgatacccattttataaatgagaaaactgaggtttttactatatgctggtcatcatgctgaggactttacttggattttctctcctgccaatgctacgcggtggggaccttcatgttctcccctttgcagatgagattatcaaagcagaaaaagaccatctctcctactgagtaacagaggaaaccagggcttgcagatattgaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 138918 - DNA, 2700 bp, Homo sapiens
  Payload ID: 7220
  Gene Symbol: GRB10
  Gene Name: growth factor receptor-bound protein 10
  Uniprot ID: Q13322
  ENST ID: ENST00000406641
  CDS Start-End: 486-2096
ctttccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacagatattctggaggaaggtgtgaacgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttccca

SEQ ID NO: 138919 - DNA, 5432 bp, Homo sapiens
  Payload ID: 7220
  Gene Symbol: GRB10
  Gene Name: growth factor receptor-bound protein 10
  Uniprot ID: Q13322
  ENST ID: ENST00000403097
  CDS Start-End: 782-2548
ggcagccgggcgccccgcggggctctccgcgctgcgttcccgacccctggggggaggtgtggagtccaagcggtgcattcttgaaccatcttgtcagacgccggcggctcgcgggctgtggcgggggctgcggtcaaggccgcgctcctgggggccgccgcctgggagggtgggcgcccaggcgtccctgcagccccgggtgctccgactgcgcggcggggccgcggcgcgcgcgcccgggcgtccgggcgtccgggacagtggtgccagacactcccaaatcccgagccggcccagcctcgtacggaggaccttttttttggttctgttggtgacccgttagccgccgctggggcctaacaccaagttgagggctcgcggattagccgcccgccagccgtggaaatgtgataagagcggtaccgtttgcagaaggaaatttctgatgcaactcttcgcctttgctgattgcctctccaaacgcctgcctgacgactgccttggagcatgtgcgttatggaaattaggctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 138920 - DNA, 2289 bp, Homo sapiens
  Payload ID: 7220
  Gene Symbol: GRB10
  Gene Name: growth factor receptor-bound protein 10
  Uniprot ID: Q13322
  ENST ID: ENST00000402497
  CDS Start-End: 337-1947
gaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaa

SEQ ID NO: 138921 - DNA, 2627 bp, Homo sapiens
  Payload ID: 7220
  Gene Symbol: GRB10
  Gene Name: growth factor receptor-bound protein 10
  Uniprot ID: Q13322
  ENST ID: ENST00000401949
  CDS Start-End: 471-2255
cagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagacttgggaggctgcattctgataattctcaggaggaagaatgtataggagagaccagggtttttaaggtgtgacctctgaaccacctacatcagagctgactgcctctcgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 138922 - DNA, 484 bp, Homo sapiens
  Payload ID: 7220
  Gene Symbol: GRB10
  Gene Name: growth factor receptor-bound protein 10
  ENST ID: ENST00000428711
  CDS Start-End: 1-327
ctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggtactgggccacaatagatctctgctgaaatagactttctgaatagaaatcctcttggaactgaatggcagcattgtaaaaaacctaaagagatcgcatctttcaccatttataaccttggctcttaagccggaggggtggttggggggagggtttagagtaaccagaaattaaaagtttccttggaaaa

SEQ ID NO: 138923 - DNA, 733 bp, Homo sapiens
  Payload ID: 7220
  Gene Symbol: GRB10
  Gene Name: growth factor receptor-bound protein 10
  ENST ID: ENST00000439044
  CDS Start-End: 390-733
cgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcaggtgctgcagcgcagtaaatgtaatttgaagaaggcagaaggaacccatggctttagccggctgcccagattcctttttgcaccatccgtactaccaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcag

SEQ ID NO: 138924 - DNA, 2382 bp, Homo sapiens
  Payload ID: 7221
  Gene Symbol: GRB14
  Gene Name: growth factor receptor-bound protein 14
  Uniprot ID: Q14449
  ENST ID: ENST00000263915
  CDS Start-End: 540-2162
atgagggtcagggctgcgcggacccctatcccgcctgcggtcctcccggcaagcccagcgggagcgcccgctcggctgggtccccgcctccagcggcgccggggccgcccagaccctgggctcagcctcgcgccccggtgcccacctgaggaggcagcggtcccggcctcgcgtcccggatgggacggcgcgggagcaatgccagtggccccgagcgccccgggccacgcgcggggccggccagccgctctcgcgccctccccgccccctccgcgccttgcctcgccgcccgcggcccccacccaccggccgctcctcccctctccccaccctcctcctccgccccctcccctcccccgccgcctcgcagatagctcggccgcgcgtctcagccgccggggccccgagcgcaggcggcgaggccaccacacctgcagagcgctcgggctgcctagccggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttaggaaaaaaa

SEQ ID NO: 138925 - DNA, 587 bp, Homo sapiens
  Payload ID: 7221
  Gene Symbol: GRB14
  Gene Name: growth factor receptor-bound protein 14
  ENST ID: ENST00000424693
  CDS Start-End: 122-587
cttttctatatactttatataatatgagccttgtcacagagtggtacatgttcgccttagcacactttttattcctgacagcaattatattttacattctgttttatgtaaattacatcctatgttctcttactgtaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactg

SEQ ID NO: 138926 - DNA, 1435 bp, Homo sapiens
  Payload ID: 7221
  Gene Symbol: GRB14
  Gene Name: growth factor receptor-bound protein 14
  ENST ID: ENST00000446413
  CDS Start-End: 189-1435
atagctcggccgcgcgtctcagccgccggggccccgagcgcaggcggcgaggccaccacacctgcagagcgctcgggctgcctagccggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatgg

SEQ ID NO: 138927 - DNA, 3181 bp, Homo sapiens
  Payload ID: 7222
  Gene Symbol: GRB2
  Gene Name: growth factor receptor-bound protein 2
  Uniprot ID: P62993
  ENST ID: ENST00000316615
  CDS Start-End: 359-889
aagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 138928 - DNA, 3248 bp, Homo sapiens
  Payload ID: 7222
  Gene Symbol: GRB2
  Gene Name: growth factor receptor-bound protein 2
  Uniprot ID: P62993
  ENST ID: ENST00000316804
  CDS Start-End: 303-956
gaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 138929 - DNA, 3729 bp, Homo sapiens
  Payload ID: 7222
  Gene Symbol: GRB2
  Gene Name: growth factor receptor-bound protein 2
  Uniprot ID: P62993
  ENST ID: ENST00000392562
  CDS Start-End: 784-1437
gagtacgggaggctgcgctcggcgcctctctcgtgccttttcctcttggctctacagcgggagtgggccccgggggaaccgggaccggccccggggttcgcgtcggggcggcgaggcttgggacgtggagcgcaatccccggggctccggactctacgtttccccttttggggcgcttccttcctggggaccgtcctcctccggctcttggctctgggcagtccgggggaagaggtcggggttctctggcgaggtcccctgccttcatcgggagggtttgcacggaaggggcccgggaagcccaggcgggccgaacgccgaccgagtcagtctacccgagcctggcggcgggggactggtgtgggctgcagctgtggtgattgatgtgccttcgacctgcacggcaaccacgtcaccatctcctggcgtctttgggcttaattttgtgcgggaatccactttggggtggaacgtttgctgctggagccgggggagatacctttattctgacacttaaaaaaaaaaactatttgaaaaatatttgtcaagaaaaattcagcagtagcaggttggactgcaccgaggaaggattgcggcgagagcgggcgctggtaattttcatttgcagcgcgccctctctatgattggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 138930 - DNA, 2851 bp, Homo sapiens
  Payload ID: 7222
  Gene Symbol: GRB2
  Gene Name: growth factor receptor-bound protein 2
  Uniprot ID: P62993
  ENST ID: ENST00000392563
  CDS Start-End: 29-559
ggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 138931 - DNA, 3182 bp, Homo sapiens
  Payload ID: 7222
  Gene Symbol: GRB2
  Gene Name: growth factor receptor-bound protein 2
  Uniprot ID: P62993
  ENST ID: ENST00000392564
  CDS Start-End: 237-890
gagccagggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 138932 - DNA, 584 bp, Homo sapiens
  Payload ID: 7222
  Gene Symbol: GRB2
  Gene Name: growth factor receptor-bound protein 2
  ENST ID: ENST00000582582
  CDS Start-End: 253-584
agtgcacacccagcgggaaggaagaggaagtgtgttcaggaatagctcaggcagctgtgccattggccggcaggcctgtcagtcgcctgggggccgaggctgaaaagaggaagaaggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgct

SEQ ID NO: 138933 - DNA, 359 bp, Homo sapiens
  Payload ID: 7222
  Gene Symbol: GRB2
  Gene Name: growth factor receptor-bound protein 2
  ENST ID: ENST00000581959
  CDS Start-End: 1-128
tcaattctttgaatgagctggtggattatcacagatctacatctgtctccagaaaccagcagatattcctgcgggacatagaacaggtgccacagattgggccatggctttcatcctgtgtcccctgacctgtccagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 138934 - DNA, 687 bp, Homo sapiens
  Payload ID: 7222
  Gene Symbol: GRB2
  Gene Name: growth factor receptor-bound protein 2
  ENST ID: ENST00000578961
  CDS Start-End: 176-646
cctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaacagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaa

SEQ ID NO: 138935 - DNA, 2243 bp, Homo sapiens
  Payload ID: 7223
  Gene Symbol: GRB7
  Gene Name: growth factor receptor-bound protein 7
  Uniprot ID: Q14451
  ENST ID: ENST00000309156
  CDS Start-End: 258-1856
aagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatac

SEQ ID NO: 138936 - DNA, 1667 bp, Homo sapiens
  Payload ID: 7223
  Gene Symbol: GRB7
  Gene Name: growth factor receptor-bound protein 7
  Uniprot ID: Q14451
  ENST ID: ENST00000394204
  CDS Start-End: 51-1394
gacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggag

SEQ ID NO: 138937 - DNA, 1955 bp, Homo sapiens
  Payload ID: 7223
  Gene Symbol: GRB7
  Gene Name: growth factor receptor-bound protein 7
  Uniprot ID: Q14451
  ENST ID: ENST00000394209
  CDS Start-End: 266-1864
aggcaaaccccagccttggactggccctctctgatctctgaggccaggctctaatgtgatttgaatctacttctaaccccttccaagcactgccctcccgaattctctgctcctctccccaccccactgttggtctgtgatttcgaggcaggcgtggccccctgcagcctggaatgaagtcactggggctgtttggagaccggggctgtttggaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacagg

SEQ ID NO: 138938 - DNA, 2093 bp, Homo sapiens
  Payload ID: 7223
  Gene Symbol: GRB7
  Gene Name: growth factor receptor-bound protein 7
  Uniprot ID: Q14451
  ENST ID: ENST00000394211
  CDS Start-End: 107-1705
cgtctccctccctgaagacgtggtcccagccgggtgtcctgacgctcggggttcaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgataca

SEQ ID NO: 138939 - DNA, 2197 bp, Homo sapiens
  Payload ID: 7223
  Gene Symbol: GRB7
  Gene Name: growth factor receptor-bound protein 7
  Uniprot ID: Q14451
  ENST ID: ENST00000445327
  CDS Start-End: 136-1803
tgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatg

SEQ ID NO: 138940 - DNA, 560 bp, Homo sapiens
  Payload ID: 7223
  Gene Symbol: GRB7
  Gene Name: growth factor receptor-bound protein 7
  ENST ID: ENST00000583813
  CDS Start-End: 223-381
acacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacg

SEQ ID NO: 138941 - DNA, 612 bp, Homo sapiens
  Payload ID: 7223
  Gene Symbol: GRB7
  Gene Name: growth factor receptor-bound protein 7
  ENST ID: ENST00000577695
  CDS Start-End: 258-612
aagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccattcgtgtgcaattcctggggcgcaggtagtaaaggtgtacagtgaggatg

SEQ ID NO: 138942 - DNA, 2345 bp, Homo sapiens
  Payload ID: 7224
  Gene Symbol: GFER
  Gene Name: growth factor, augmenter of liver regeneration
  Uniprot ID: P55789
  ENST ID: ENST00000248114
  CDS Start-End: 7-624
ggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccaccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgccttagaa

SEQ ID NO: 138943 - DNA, 483 bp, Homo sapiens
  Payload ID: 7224
  Gene Symbol: GFER
  Gene Name: growth factor, augmenter of liver regeneration
  ENST ID: ENST00000567719
  CDS Start-End: 4-396
agaatgaactcactctcggtcggcctgcttccgcagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagag

SEQ ID NO: 138944 - DNA, 482 bp, Homo sapiens
  Payload ID: 7224
  Gene Symbol: GFER
  Gene Name: growth factor, augmenter of liver regeneration
  ENST ID: ENST00000561710
  CDS Start-End: 1-420
aacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggtaagatgtgtttgcacgcagcagagctttgcactggagcctgggcctggggctcctggctgacgt

SEQ ID NO: 138945 - DNA, 517 bp, Homo sapiens
  Payload ID: 7224
  Gene Symbol: GFER
  Gene Name: growth factor, augmenter of liver regeneration
  ENST ID: ENST00000569451
  CDS Start-End: 13-342
tgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagcca

SEQ ID NO: 138946 - DNA, 803 bp, Homo sapiens
  Payload ID: 7225
  Gene Symbol: GH1
  Gene Name: growth hormone 1
  Uniprot ID: P01241
  ENST ID: ENST00000323322
  CDS Start-End: 44-697
ccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 138947 - DNA, 537 bp, Homo sapiens
  Payload ID: 7225
  Gene Symbol: GH1
  Gene Name: growth hormone 1
  ENST ID: ENST00000342364
  CDS Start-End: 63-431
aggatcccaaggcccaactccccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 138948 - DNA, 685 bp, Homo sapiens
  Payload ID: 7225
  Gene Symbol: GH1
  Gene Name: growth hormone 1
  Uniprot ID: P01241
  ENST ID: ENST00000351388
  CDS Start-End: 43-576
cccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattt

SEQ ID NO: 138949 - DNA, 756 bp, Homo sapiens
  Payload ID: 7225
  Gene Symbol: GH1
  Gene Name: growth hormone 1
  Uniprot ID: P01241
  ENST ID: ENST00000458650
  CDS Start-End: 42-650
ccgaaccactcagggtcctgtggacagctcacctagctgcaatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 138950 - DNA, 376 bp, Homo sapiens
  Payload ID: 7225
  Gene Symbol: GH1
  Gene Name: growth hormone 1
  ENST ID: ENST00000617086
  CDS Start-End: 63-155
aggatcccaaggcccaactccccgaaccactcagggtcctgtggacagctcacctagctgcaatggctacagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatca

SEQ ID NO: 138951 - DNA, 1138 bp, Homo sapiens
  Payload ID: 7226
  Gene Symbol: GH2
  Gene Name: growth hormone 2
  Uniprot ID: P01242
  ENST ID: ENST00000332800
  CDS Start-End: 135-905
gagaaacaggtgaggagaagcagcgagagagaaggggccaggtataaaaagggcccacaagagaccagctcaaggatcccaaggcccaactccccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtgggtgagggtggcaccagggatccccaatcctggggccccactggcttccagggactggggagagaaacactgctgccctctttttagcagtcaggcgctgacccaagagaactcaccgtattcttcatttcccctcgtgaatcctccaggcctttctctacaacctggaggggagggaggaaaatggatgaatgagagagggagggaacagtgcccaagcgcttggcctctccttctcttccttcactttgcagaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaa

SEQ ID NO: 138952 - DNA, 794 bp, Homo sapiens
  Payload ID: 7226
  Gene Symbol: GH2
  Gene Name: growth hormone 2
  Uniprot ID: P01242
  ENST ID: ENST00000456543
  CDS Start-End: 42-779
ccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgataggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgca

SEQ ID NO: 138953 - DNA, 819 bp, Homo sapiens
  Payload ID: 7226
  Gene Symbol: GH2
  Gene Name: growth hormone 2
  Uniprot ID: P01242
  ENST ID: ENST00000423893
  CDS Start-End: 63-716
aggatcccaaggcccaactccccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtggaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgca

SEQ ID NO: 138954 - DNA, 753 bp, Homo sapiens
  Payload ID: 7226
  Gene Symbol: GH2
  Gene Name: growth hormone 2
  Uniprot ID: P01242
  ENST ID: ENST00000449787
  CDS Start-End: 42-650
ccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtggaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgca

SEQ ID NO: 138955 - DNA, 702 bp, Homo sapiens
  Payload ID: 7226
  Gene Symbol: GH2
  Gene Name: growth hormone 2
  ENST ID: ENST00000622506
  CDS Start-End: 63-596
aggatcccaaggcccaactccccgaaccactcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtggaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgcatca

SEQ ID NO: 138956 - DNA, 2128 bp, Homo sapiens
  Payload ID: 7227
  Gene Symbol: GHITM
  Gene Name: growth hormone inducible transmembrane protein
  Uniprot ID: Q9H3K2
  ENST ID: ENST00000372134
  CDS Start-End: 194-1231
ttttccgacagaggcctgcccgtgattggctgctcgtactatttacgtcctttcgatgttgcgtcatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacc

SEQ ID NO: 138957 - DNA, 2375 bp, Homo sapiens
  Payload ID: 7227
  Gene Symbol: GHITM
  Gene Name: growth hormone inducible transmembrane protein
  ENST ID: ENST00000618907
  CDS Start-End: 132-1091
gtcatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacctcttcaagctttcaagcctttatagaaaagcttctttgtggcttacactggaaattatgaaagcagtttttctcctaagacttttggtttctcgcattgcctctcagactaagcactaaaaagcaaagcaaaacagaactagttctgtcttaatgaaatatatcaacccaaaagtgtaatgaggaaaatgcttcattagtttcccctagcagacttttacttctcttacactgctacaccattactttcttgagacatttgtaagttctttgatacagaagagttatatttagaagtctttaatgaaggg

SEQ ID NO: 138958 - DNA, 4560 bp, Homo sapiens
  Payload ID: 7228
  Gene Symbol: GHR
  Gene Name: growth hormone receptor
  Uniprot ID: P10912
  ENST ID: ENST00000230882
  CDS Start-End: 191-2107
gcggcggcggcggcagcggcagcagcagctgctacagtggcggtggcggcggcggctgctgctgagcccgggcggcggcggggaccccgggctggggccacgcgggccggaggccccggcaccattggccccagcgcagacgcgaacccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacc

SEQ ID NO: 138959 - DNA, 4316 bp, Homo sapiens
  Payload ID: 7228
  Gene Symbol: GHR
  Gene Name: growth hormone receptor
  Uniprot ID: P10912
  ENST ID: ENST00000357703
  CDS Start-End: 12-1862
gtcctacaggtatggatctctggcagctgctgttgaccttggcactggcaggatcaagtgatgctttttctggaagtgaggattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138960 - DNA, 2173 bp, Homo sapiens
  Payload ID: 7228
  Gene Symbol: GHR
  Gene Name: growth hormone receptor
  ENST ID: ENST00000511135
  CDS Start-End: 20-277
gattgcaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaagaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggt

SEQ ID NO: 138961 - DNA, 566 bp, Homo sapiens
  Payload ID: 7228
  Gene Symbol: GHR
  Gene Name: growth hormone receptor
  ENST ID: ENST00000513671
  CDS Start-End: 93-281
tttgtgcgggccgcagccgcacgttggcaccgatggaactggggtcagtagagtgacagccaccagtccgcatgaactggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaagatggggtccatgctcacatatcaagaaaatggagtcttacatgcaagcctaatgcagagtagagaagctcaccaacttgaaggaagcatgaatgaaattacaaggaaatctagcttagaaaaattaaccctgtagcttggtttttccactctttgctcttggcaaaaggatcttacgggaaaactggagcttagagaacttatgtaacattactagcaagttgcacagctgggattcaaactgaaatccagctagcttcaaagactgtgttctttctgctgctgcatactacccctacctaccaaggctctgagattagaaagcaggatgggtgtgt

SEQ ID NO: 138962 - DNA, 4419 bp, Homo sapiens
  Payload ID: 7228
  Gene Symbol: GHR
  Gene Name: growth hormone receptor
  Uniprot ID: P10912
  ENST ID: ENST00000537449
  CDS Start-End: 49-1965
caatgatattagctatgacagcacgtatgagcctggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138963 - DNA, 4814 bp, Homo sapiens
  Payload ID: 7228
  Gene Symbol: GHR
  Gene Name: growth hormone receptor
  Uniprot ID: P10912
  ENST ID: ENST00000615111
  CDS Start-End: 444-2360
ggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactgggttaaaatgagcaacttctttaaccagaactgaccttgaagacaaatggctaaaataaaacatttgctgaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138964 - DNA, 4699 bp, Homo sapiens
  Payload ID: 7228
  Gene Symbol: GHR
  Gene Name: growth hormone receptor
  Uniprot ID: P10912
  ENST ID: ENST00000612382
  CDS Start-End: 329-2245
agatatgtgtgtgtgtgcatgagagagagagattgagaatgactgatttgggagggattttgtgaaggtttatatatcaaagcagaaagaccaagaatttagagattaatacatgccaagtggtaaccaagaaacttctgtgggatcccacctccaacccctccctctctgtcagattttaaccaaatcagtgtgatgtgatctgcttgcatatatgagtgaaagaaaaaggaaatttaaaaagttcttgatataaagcctggaggaaacaatacgaaaatccagcctctatttcagcaatatctgccggactattggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138965 - DNA, 4524 bp, Homo sapiens
  Payload ID: 7228
  Gene Symbol: GHR
  Gene Name: growth hormone receptor
  Uniprot ID: P10912
  ENST ID: ENST00000612626
  CDS Start-End: 154-2070
ggggaatgagtagcaaagatggattaagtgagaagagtataggaggcagcagggccagaggtgtgaatagcccagaaccttctgagaagattcctttgtggacggaagaaaggggaggtttgtggaaatggtggaagataaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138966 - DNA, 4491 bp, Homo sapiens
  Payload ID: 7228
  Gene Symbol: GHR
  Gene Name: growth hormone receptor
  Uniprot ID: P10912
  ENST ID: ENST00000618088
  CDS Start-End: 121-2037
cctcttctcagctgatttggctgcctccattgtaataggcctcatgagactccagcctaggcctggccttcagttcagcaggcagagcccagagatgtactgggcaaaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138967 - DNA, 4529 bp, Homo sapiens
  Payload ID: 7228
  Gene Symbol: GHR
  Gene Name: growth hormone receptor
  ENST ID: ENST00000620156
  CDS Start-End: 138-2075
ggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactggggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138968 - DNA, 4312 bp, Homo sapiens
  Payload ID: 7228
  Gene Symbol: GHR
  Gene Name: growth hormone receptor
  ENST ID: ENST00000622294
  CDS Start-End: 12-899
gtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacca

SEQ ID NO: 138969 - DNA, 1294 bp, Homo sapiens
  Payload ID: 7229
  Gene Symbol: GRTP1
  Gene Name: growth hormone regulated TBC protein 1
  Uniprot ID: Q5TC63
  ENST ID: ENST00000326039
  CDS Start-End: 9-809
gcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggagggtgcacaggacgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggcaaacgtgggcggtatttcagcagctgggccttcatcaaagagaagaccatgttggccgggcgcggtggctcacgcctgcagtcccagcactttgggaggccaaggcgtgtggatcacctga

SEQ ID NO: 138970 - DNA, 1834 bp, Homo sapiens
  Payload ID: 7229
  Gene Symbol: GRTP1
  Gene Name: growth hormone regulated TBC protein 1
  Uniprot ID: Q5TC63
  ENST ID: ENST00000375430
  CDS Start-End: 98-1132
cgcgcccgcggtcccgccggaaggacttaagcgccccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggagggtgcacaggacgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggcaaacgtgggcggtatttcagcagctgggccttcatcaaagagaagaccatgttggccgggcgcggtggctcacgcctgcagtcccagcactttgggaggccaaggcgtgtggatcacctgaggtcaggagttcaagaccagcctggccaacacggtgaaaccccgtctctactaaaaaatacaaaaattagccaggtgtggtggctcacgcttatgtagtcccagttactcgggaggctgaggcacgagaatcacttgaacctgggaggcggaggttgcagtgagccgagatcgcgccactgcactccagcctgggcaacagagtgagactctgtctc

SEQ ID NO: 138971 - DNA, 1384 bp, Homo sapiens
  Payload ID: 7229
  Gene Symbol: GRTP1
  Gene Name: growth hormone regulated TBC protein 1
  Uniprot ID: Q5TC63
  ENST ID: ENST00000375431
  CDS Start-End: 76-1086
ggacttaagcgccccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtgggtttgtatctaataaagtatgccaacacctgtgtttgtga

SEQ ID NO: 138972 - DNA, 1073 bp, Homo sapiens
  Payload ID: 7229
  Gene Symbol: GRTP1
  Gene Name: growth hormone regulated TBC protein 1
  ENST ID: ENST00000620217
  CDS Start-End: 98-808
cgcgcccgcggtcccgccggaaggacttaagcgccccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtgggtttgtatctaataaagtatgccaacacctgtgtttgtgatcagtttctcagctgactggaaatta

SEQ ID NO: 138973 - DNA, 461 bp, Homo sapiens
  Payload ID: 7230
  Gene Symbol: GHRH
  Gene Name: growth hormone releasing hormone
  Uniprot ID: P01286
  ENST ID: ENST00000237527
  CDS Start-End: 8-334
gtgaaggatgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacagcaggaactcccagggatgaagattcctcctgtgacccgggctacctgtagccaaaatgcaactggatccagttaatcctctcatttctgacccactttttcctttgaaaatacaataaaattcccccataccggtgtgcatttaaa

SEQ ID NO: 138974 - DNA, 377 bp, Homo sapiens
  Payload ID: 7230
  Gene Symbol: GHRH
  Gene Name: growth hormone releasing hormone
  Uniprot ID: P01286
  ENST ID: ENST00000373611
  CDS Start-End: 1-324
atgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacaggaactcccagggatgaagattcctcctgtgacccgggctacctgtagccaaaatgcaactggatccagt

SEQ ID NO: 138975 - DNA, 570 bp, Homo sapiens
  Payload ID: 7230
  Gene Symbol: GHRH
  Gene Name: growth hormone releasing hormone
  Uniprot ID: P01286
  ENST ID: ENST00000373614
  CDS Start-End: 113-439
tgggaacgccaggcggctgccagagcaaacacccagcccagggcccctggatttgagcagtgcctcggagcagagggatatctgccgcatcaggtgccaccccgggtgaaggatgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacagcaggaactcccagggatgaagattcctcctgtgacccgggctacctgtagccaaaatgcaactggatccagttaatcctctcatttctgacccactttttcctttgaaaatacaataaaattcccccataccggtgtgcatttaaatgtt

SEQ ID NO: 138976 - DNA, 1602 bp, Homo sapiens
  Payload ID: 7231
  Gene Symbol: GHRHR
  Gene Name: growth hormone releasing hormone receptor
  Uniprot ID: Q02643
  ENST ID: ENST00000326139
  CDS Start-End: 47-1318
ccaaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacaagcagcagaggagatgcccaacaccaccctgggctgccctgcgacctgggatgggctgctgtgctggccaacggcaggctctggcgagtgggtcaccctcccctgcccggatttcttctctcacttcagctcagagtcaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacctgtaaatgaa

SEQ ID NO: 138977 - DNA, 1241 bp, Homo sapiens
  Payload ID: 7231
  Gene Symbol: GHRHR
  Gene Name: growth hormone releasing hormone receptor
  ENST ID: ENST00000337750
  CDS Start-End: 259-465
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggagggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacctgtaaatgaataga

SEQ ID NO: 138978 - DNA, 1459 bp, Homo sapiens
  Payload ID: 7231
  Gene Symbol: GHRHR
  Gene Name: growth hormone releasing hormone receptor
  ENST ID: ENST00000396227
  CDS Start-End: 259-696
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacct

SEQ ID NO: 138979 - DNA, 1292 bp, Homo sapiens
  Payload ID: 7231
  Gene Symbol: GHRHR
  Gene Name: growth hormone releasing hormone receptor
  ENST ID: ENST00000409316
  CDS Start-End: 438-893
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacctgtaaatgaa

SEQ ID NO: 138980 - DNA, 1613 bp, Homo sapiens
  Payload ID: 7231
  Gene Symbol: GHRHR
  Gene Name: growth hormone releasing hormone receptor
  ENST ID: ENST00000409904
  CDS Start-End: 259-1338
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacct

SEQ ID NO: 138981 - DNA, 923 bp, Homo sapiens
  Payload ID: 7231
  Gene Symbol: GHRHR
  Gene Name: growth hormone releasing hormone receptor
  ENST ID: ENST00000611037
  CDS Start-End: 131-754
ccactgcccccggaactacgtccacacccagctgttcaccacttttatcctcaaggcgggagctgtgttcctgaaggatgctgcccttttccacagcgacgacactgaccactgcagcttctccactgtaatggccatgggtgaaggggctgggcaggtgggggagagaggaggttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggattcgcagactgggcctacgatgcagattcctgggcagatcctttgactgccagcctccccgcgggtcctgagaggagagtttcctaaagagaaggaagaaactcggacttccctcctgttatgttcgggctcctctgtgagaaagaggaggagagaggaaaatgaagggcccattctctgtccccagagagcccccaggaatgttgggaagatctgcaaggatgagcctgaacctagagg

SEQ ID NO: 138982 - DNA, 1172 bp, Homo sapiens
  Payload ID: 7232
  Gene Symbol: GHSR
  Gene Name: growth hormone secretagogue receptor
  Uniprot ID: Q92847
  ENST ID: ENST00000241256
  CDS Start-End: 44-1144
cagcgcagtcacgtcccagagcctgttcagctgagccggcagcatgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggcatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctggctgtagtggtgtttgccttcatcctctgctggctccccttccacgtagggcgatatttattttccaaatcctttgagcctggctccttggagattgctcagatcagccagtactgcaacctcgtgtcctttgtcctcttctacctcagtgctgccatcaaccccattctgtacaacatcatgtccaagaagtaccgggtggcagtgttcagacttctgggattcgaacccttctcccagagaaagctctccactctgaaagatgaaagttctcgggcctggacagaatctagtattaatacatgacctagcacattgcgagtacagtcaccgc

SEQ ID NO: 138983 - DNA, 912 bp, Homo sapiens
  Payload ID: 7232
  Gene Symbol: GHSR
  Gene Name: growth hormone secretagogue receptor
  Uniprot ID: Q92847
  ENST ID: ENST00000427970
  CDS Start-End: 43-912
agcgcagtcacgtcccagagcctgttcagctgagccggcagcatgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggcatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctgggtgggtctcagcgcgcgctcaggctttctctcgcgggtcctatcctctccctgtgccttctcccttctctctga

SEQ ID NO: 138984 - DNA, 8444 bp, Homo sapiens
  Payload ID: 7233
  Gene Symbol: GREB1
  Gene Name: growth regulation by estrogen in breast cancer 1
  Uniprot ID: Q4ZG55
  ENST ID: ENST00000234142
  CDS Start-End: 263-6112
gaggcagctcctagtgaaacagtctaagaggtgtcaggctctgctgagtgctaaattagagaaagctgttacttatataacttcctgtaattgcccggcagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 138985 - DNA, 2448 bp, Homo sapiens
  Payload ID: 7233
  Gene Symbol: GREB1
  Gene Name: growth regulation by estrogen in breast cancer 1
  Uniprot ID: Q4ZG55
  ENST ID: ENST00000263834
  CDS Start-End: 428-1657
gatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaagtatttgtaaatggtgctacccaaatggtagcccttggtccggcagaacctgcatcgccccggagcttatgagaggcgtgaattcatggacccatcctggaatcagaatcaggccccacttctgcatcagaagccctgggtggcaccagcaagtgtttggcaagcccttgagaagcagtgtctttgagaacgtgacctgtgccccaggcaccagctttactccccgagcccagcaggacatctgcatataacacacagccgaagtcagaaaatatatttttggtgactaaatggagtacctggagtacaagataacacacacacacacacacacacacacacacacacacacacacacacacgccacctttgggagctcagcagccccgagaggatttgatagcttcaccgcttcacctggttttacaaatgcggagactgaggtttagggcagttaagcttcttgcttagcatcatgtaggtaaagaatggtggaaagatatttgaacccgacctgggcaattccacctctgagggctgtcctcagaatgaatcttctgatgggctgggcacggtggctcacgcctgtaatcccagaactttgagaggccgaggcgggtagatcactttaggtcagaagttcaagatcagcctgggcaacatggtgaaaccttgtctctactaaaaatacaaaaattggccgggtgtggtggtgatgcgcacctgtcatcccagctactcgggaggctgaggtgggagaatcacttgaacttgggaggcagaggttgtggtgagccgagatcacgccactgcactccagcccggggacagagcaagacactgtctcaaaaaaaaaaaaagaa

SEQ ID NO: 138986 - DNA, 2347 bp, Homo sapiens
  Payload ID: 7233
  Gene Symbol: GREB1
  Gene Name: growth regulation by estrogen in breast cancer 1
  Uniprot ID: Q4ZG55
  ENST ID: ENST00000381483
  CDS Start-End: 252-1625
gaaagaatcaaagcgcacatcttgtactttgatgcccataggaagggctctcctctggcccctctggctttgtttggagcagaaaacaacaaactgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggcacatcaaatacgaaatccggacgtataaaccagacaattcataaaagagaaaataccagaaggaaacaaatattgaaaagtattcagtctcactcatcatcaaagacatgcaaatcacaaatcaagtcatctttttctgaattaataacccaaatgatggtacccagtggtgcttaggtgcggtaaaaccagcgcttgtccgatgcaccgttcgcgtggtaaactgacgcattcaggctcttgggaagcaatctgatgatatgtagtagctggttctgtaaatccacctttgagaatttaggcgaaggaagtaacgttctatatgtcaagatgtgcattgcagagggatttataaaggtgaatatttggaagaaataagagaatccacaatagagaccttgctaagtaaacggtggtgctcacgtatgatgggacattatggacacactaacagcactctttatgttggctgaaaatggcactgaaactgatgatagggtcatggttaaggaaagaatgcaagacccaaagtttatactgacaatcattgcagctatttgtaaggacagttttaatactaattccagcaatacatgtttttattccctgtcctggagtaggagaaagcctatattcccaggctgaatgttctacacatttaccactgtatatgcacatagggacagtgtaacctgtctataccaccgtagttccagtcctaactttctgaattctgtttaaagaccttct

SEQ ID NO: 138987 - DNA, 8484 bp, Homo sapiens
  Payload ID: 7233
  Gene Symbol: GREB1
  Gene Name: growth regulation by estrogen in breast cancer 1
  Uniprot ID: Q4ZG55
  ENST ID: ENST00000381486
  CDS Start-End: 301-6150
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgta

SEQ ID NO: 138988 - DNA, 1315 bp, Homo sapiens
  Payload ID: 7233
  Gene Symbol: GREB1
  Gene Name: growth regulation by estrogen in breast cancer 1
  ENST ID: ENST00000389825
  CDS Start-End: 312-1073
gacacggggcggctgagcagcagtgtgttcatggagaaagaatcaaagcgcacatcttgtactttgatgcccataggaagggctctcctctggcccctctggctttgtttggagcagaaaacaacaaagtgagttcaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtagctctgcctgtcctggccgtcctggggatcctgctcttctttgggccaaggccagagggggcatgggagctgctgggctggggccgctgagcctcctggagtctgatgtggcttccatgagagtcaggccaggaccacaggtgcctcctgagtccgtgggtctgggcccaggccctggtgctctatgagtgacacttgggagttaccgtatgtgccaaggagcagtgagacacctgtggtaatggcgagtgacctgtcctatgggctgcacagctggaggatggtagaattttggagcaatagtgggcagtgtgttgttggggaagaacatgggcttctgaatcagaaaaatatgaattcaaaacctaccgctgtctcttgttagtcaggggaccttggccaagtctcaataaatgtttcttcatctgga

SEQ ID NO: 138989 - DNA, 5296 bp, Homo sapiens
  Payload ID: 7233
  Gene Symbol: GREB1
  Gene Name: growth regulation by estrogen in breast cancer 1
  Uniprot ID: Q4ZG55
  ENST ID: ENST00000396123
  CDS Start-End: 119-2962
gctgatagagatgtcttggacatgctctggctggctaatctccatgttctagccgactgaaaatacggtggccaagtggatggtgtgcttatttgcagtctaaagaaatttccttttgatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgta

SEQ ID NO: 138990 - DNA, 2052 bp, Homo sapiens
  Payload ID: 7233
  Gene Symbol: GREB1
  Gene Name: growth regulation by estrogen in breast cancer 1
  ENST ID: ENST00000432985
  CDS Start-End: 430-2052
ctggtctctgtggtgatatattgtcccaactcaccttgccagacagccctgggagaatgcagggcagaatcctccctgcttggagtcagggaggcaagacctggcaggcagcacccagtgaagctctggaaggtgctctgcccacaaggtgtcccattggtggtgctggaggagtgacaggtggcggctgcttggctctgggcaagtccctccctccagccccctcacttgtaaaaaataagaggattggacgaaatgaaccagcaagtggcacagccccattggttagaaaaggtgactcctctcatcctaggctccaggagggtgagcaggtgcactcaatgagcaaggcttcccaggacagggcactcgagggacctggcgcagctcacctatctccttcagtgccctcacccccagagaacccacatgtatgggaccgtaagctgtgcacaagactgggtgccaagtcgctgctgttcctctgcaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactac

SEQ ID NO: 138991 - DNA, 438 bp, Homo sapiens
  Payload ID: 7233
  Gene Symbol: GREB1
  Gene Name: growth regulation by estrogen in breast cancer 1
  ENST ID: ENST00000628795
  CDS Start-End: 200-438
ctcaggtgcgaggttccgtccatctttctgaacccacgcagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttcca

SEQ ID NO: 138992 - DNA, 5600 bp, Homo sapiens
  Payload ID: 7234
  Gene Symbol: GREB1L
  Gene Name: growth regulation by estrogen in breast cancer-like
  Uniprot ID: Q9C091
  ENST ID: ENST00000269218
  CDS Start-End: 156-5600
ccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatga

SEQ ID NO: 138993 - DNA, 6052 bp, Homo sapiens
  Payload ID: 7234
  Gene Symbol: GREB1L
  Gene Name: growth regulation by estrogen in breast cancer-like
  Uniprot ID: Q9C091
  ENST ID: ENST00000424526
  CDS Start-End: 272-6043
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaa

SEQ ID NO: 138994 - DNA, 568 bp, Homo sapiens
  Payload ID: 7234
  Gene Symbol: GREB1L
  Gene Name: growth regulation by estrogen in breast cancer-like
  ENST ID: ENST00000580384
  CDS Start-End: 1-568
acgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatgccatccataacttcaggagtcctgtgctggccattgactgctaccttaacattggaccagaggtggccatatgctatatcagctccagaccccactccagcaatgtcaactgtg

SEQ ID NO: 138995 - DNA, 598 bp, Homo sapiens
  Payload ID: 7234
  Gene Symbol: GREB1L
  Gene Name: growth regulation by estrogen in breast cancer-like
  ENST ID: ENST00000579454
  CDS Start-End: 1-598
gaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagattcgccgattctcagtccagctaattctgcaatcaatttaagtggagctcaggacctgacccggaataacaatgttgtgaaaccactggctttatctttgcaggttgtagggaagacttttgctgcagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagcccctt

SEQ ID NO: 138996 - DNA, 682 bp, Homo sapiens
  Payload ID: 7234
  Gene Symbol: GREB1L
  Gene Name: growth regulation by estrogen in breast cancer-like
  ENST ID: ENST00000581327
  CDS Start-End: 1-528
ctcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctgggtaatgtcatctcagaccaagaggaggaagtcagtccttgggacagacattgtaaaaactaagtcattctaagggttttgaggattcttcaagtcacagaccacaacagccttttcctgattgtctacatgataaacctggttgaaattaaaaatgctttcccatgtggcctggatcaaaggctttgttcctagtaaaagtcttctggaatgaaaa

SEQ ID NO: 138997 - DNA, 8749 bp, Homo sapiens
  Payload ID: 7234
  Gene Symbol: GREB1L
  Gene Name: growth regulation by estrogen in breast cancer-like
  Uniprot ID: Q9C091
  ENST ID: ENST00000580732
  CDS Start-End: 382-6153
gtttctgagagcatctgtcactttaggcattacaagatggatgggtctccagtgaactgctggttgaagcaaatggtgaaaataagaaaatcaaggggtttcagggtctgcagaggggacagacaacaaggaaacactgttagaaatcaagagtaagctgagcaatagaggaagagagcaaagatggatcagatgtcattttataaacatcttggaaatcagaatcttttggtggctttcgtgatctgagggagacatctgcatcatggtgcacaaaaagctttaaacaagttaaaatctaggcaacagactccctgaagtgttgactgcccaacttaatcatgactgtgattcaaaaatgttaataaataaaccaagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagctaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtgtccttgtagacttgggtctggaggaaaatgggacagcccatcagagagcagaaaaatatgttgttcgtctagacaatgagattcaaaccaagtttgaagtttttatgaggagagtgaaacagaacccgtacacactgtttgtgctagttcatgacaactcccatgtggaactaacgagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggaatgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtgctgccaggttcctcatcaaggagctatcatatcacaacctagaattggagagaaaccgcctggaggagctaggcattaaacgccagtgtgtctggcctttcatcgtcatgatggatgactcatgtgtcctatggaacattcacagtgttcaggagccatccagccagcccatggaagtaggagtttccagtaagaatgtgtccttgaagactgtcttgcagcacattgaagccacaccaaaaattgtccactatgcaatcttgggcatacagaaatggagcagcaagctgacttctcagagcctaaaggccccattctctaggtgtcacgtgcatgatttcattctcctcaacacagacttgactcagaatgtgcagtatgacttcaacaggtatttctgtgaagatgctgactttaatctgagaacaaacagtagtggcctgctcatctgccgctttaataacttcagtctcatgaagaaacatgttcaggttggagggcaaagggactttatcattaaaccaaagatcatggtgtcagagagcttagcacccatcttgccccttcaatacatctgtgctcccgacagtgaacacacactactggcagcccctgcacagtttctcctggagaaattccttcagcacgcctcatataaactcttccccaaagccatccataacttcaggagtcctgtgctggccattgactgctaccttaacattggaccagaggtggccatatgctatatcagctccagaccccactccagcaatgtcaactgtgaaggggtgtttttcagtggactccttttgtacctctgtgactcttttgtaggtgctgatcttaagaaatttaaatttctaaaaggtgctacactgtgtgtcatctgccaagacagaagttccttgcgccaaacaattgtccgcttagagctagaagatgagtggcagttccgcctccgggacgagtttcaaactgctaacagcagtgatgacaagcctctctactttcttactggacgtcatgtatgagcttttgaagagaccaaaacagcaaaaagatgcctaggtgggatgggacagaaacaatttgggatttttctttttcctttaaagtacaatcactgtggagcaaagtgcaacatatttgtctaaattctccaaagaactccccaaatctgatccaggtctttggggacatcactttccttcagttccaattacaggacccttaaattcaggtaaactctatcctaggcagttatgcaattacttaagatacggtctgcccatgggatcctgaggaggatatactttggagagtgaatatggagtttgcattatttttttctattactatgttagggggaaactgactgtcaggattaactagcctgaatgtgttacatgagactcatgccattggtgtggaatcaattgaagattaacgtttgaggcctgaaccctcagtttctcttcagatctgtactttggtacagtattactcaggggtttgaaatgatagaatgtagacgatatttgtatttaaaaaaagaagtagctttgtctttctctgtgcagtgttagtttaagatttataatcttctatgtattgaaacttttggcaaaatttccacaggagttagaagtttactatttaaactgaacaaacaaatcagtaaatgcagagcaggcattgtgtgcatttatgcatcttctcctagcctaattcctttgctttacccactctttaaatgtgtttccagtctttaagaatatcttatctatgagactatggaacagtgattaatcttttgcaagaacttaagtcagttaagaagctttcagcaggtaacctgcacccaccgtttggttggaattaagcagttggcaccagcaaacctaaatgtcaggctgaggttctgttgcagagtgaaactagtttgtttcctttcagggactcaagcaaagcttcctttaaaagatgcactaaatattaccaccttacactgacaacgccacagaaattgccgaattgggaaattgagccatagaaagagaaatgtttttttacttaatcttaccagtgactcttgtgaggagtaaggaagactccattaagagtctttttgattcattaaaatcagcagggggtgtttgtccagtatcggcaatgggaggcatatgtttctacagatttctcaaatattttaatcaaaaacattatttttagaaagtgttctagataaaactaagtcttagaagtttactcttaaattactccagttctcatcattgaacaatctcttgagagttttctcattagcccatatttactactttatccccacttaaaatggccatttttacttgaatcaatcttgtttgtgacctgaaactactgaggggcctactaagcctgcatttacttagaacaaatagtgttaattgaccagctttattatcttatgacaacaaggagtttacaaagctagtgaaaaaatggaatgtattagactaaaaatggtttgcagatctcttggttttaatatagctacttataatgctttaactgtattttgaagtgaacaattccttttaaccccatttttaattgtccttcaaagaggacctgccttatatatgctttaaaaaatactccttaattttagtacagcagaatttttggtaaagaggtatgttttgaagcaatttggtttaaatatgaatgtatttcacttgttcctgttttgttgaaagggcctaatgcaaataataccaagaaacccactgtctgtgcaatattccaataacatttacatagggcaaataaaatacttgaaagaattctgaaacaattgtacctggggtggatggcctctcagggtttcttctggctttatgacttcatagtttaaagaactttttttttaagtagttacatcagatgcaggtactccattagttagggctgcactctgaaaattcaaattattattatgagctcttaaatactatttaactctggaagagatatgccagaataaagccaaaagaccatcacccctataatggagaaattgatctgcctattcttttcaaagcctatcttactaatgtttggatcttttaaaatcatcttatcatcagtataattcttgagtatgttaggtccttctttaaggataaaattgcacaagcacaggacaccatgatttgtgtgtatatatatatatatcctagtgtgttcagctttaagctttgcaatcccttaggacactgatgtgggatgaatggattcgctaggcccacacagtaactcacctgtagacctgctgaacctcagcatgtatgacagttcacacaggttaatactgaatgtaaacgaaaaactagaagacaattgttataattttttttggctgtaatttatgcaattgctttttgtgatttttagaaaatggggcacccgtgttattactgtaaaatgttcttaaccaaaatttggtgaatttcactagtctacctcacattttgttaatgattcaaaattgtcttgtgtctactgttatatttttgtcctttgatttaatttgcttaatgtattaaagttatctcccaccccctc

SEQ ID NO: 138998 - DNA, 1933 bp, Homo sapiens
  Payload ID: 7235
  Gene Symbol: GRASP
  Gene Name: GRP1 (general receptor for phosphoinositides 1)-associated scaffold protein
  Uniprot ID: Q7Z6J2
  ENST ID: ENST00000293662
  CDS Start-End: 81-1268
ccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaagggctcaggattccgctggaagaatctcagccagagtcctgaacagcagcggaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttcatccccggactcaaccgctccctggaggaggaggagagccagctgtaggggcgggggcgggcagggaggtatttatttatttattcgcaacagccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaa

SEQ ID NO: 138999 - DNA, 794 bp, Homo sapiens
  Payload ID: 7235
  Gene Symbol: GRASP
  Gene Name: GRP1 (general receptor for phosphoinositides 1)-associated scaffold protein
  ENST ID: ENST00000546756
  CDS Start-End: 131-794
ccaggctgtggctgaatttcgggccttagctagtcagaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctct

SEQ ID NO: 139000 - DNA, 1688 bp, Homo sapiens
  Payload ID: 7235
  Gene Symbol: GRASP
  Gene Name: GRP1 (general receptor for phosphoinositides 1)-associated scaffold protein
  Uniprot ID: Q7Z6J2
  ENST ID: ENST00000552049
  CDS Start-End: 242-1000
gaggctccaggctgtggctgaatttcgggccttagctagtcagaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggtggggcctgagcccaggacacccaggtctgggaaggggatatgaccttactcccaagcaaagggggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttcatccccggactcaaccgctccctggaggaggaggagagccagctgtaggggcgggggcgggcagggaggtatttatttatttattcgcaacagccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaactgtataaatggatggttttttg

SEQ ID NO: 139001 - DNA, 2775 bp, Homo sapiens
  Payload ID: 7236
  Gene Symbol: GRPEL1
  Gene Name: GrpE-like 1, mitochondrial (E. coli)
  Uniprot ID: Q9HAV7
  ENST ID: ENST00000264954
  CDS Start-End: 166-819
aagatgctcttccgtgacccacaattattggtgactattgcctgtccataacaggaaaagcgattacggattggctgaggcgaagtagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttcctactttctgaaaacaattttgtgtcctctcatggagatccttgccgctgaggcaagcatggcttagccttcccattctctactccagcccagaagctgtcagcttgacacgtgcgtgcgtgcacattcacgtacacacatatacaggcttctacacagaaagggagagccacactcccccagtgcagctgcagcccgtccggtaagaatacgaaacacccaggagccacagcaagggcacaggatttgcaaaatcatcttgccaaagggctgttcctcatttacacggtcatccagggcttagaaaaaggctgaatgattggcgtctgttacaaaaaagagaaaagaacctttcgctgcctttgcttctagaatggaagatacttgtgaaagccatttgctgcacaggaaagatggggcagtttatttcacttctaattttaaaagacgcaagtaatggtcccataatacttcatcttgggataccattcccaaacatgttccacctttaagatgccttaagttaatttggtcagaaacaactaaaggcagcatcgtgtattgaagaaaacatgactgggagctccagcgctgcctgttttcacgctgtggggttgtgagtgcatcatcacccctggagctcccgagttaaatggaggctaagaaaagtaatttatcaactcatttctgtgaatgtttgcagtctcctaccgtctcaactacagctgcagttgctaaaaagcacttaactcgtaacctagaggcaatatagcttaagtagcaaaatatttttttacagtaagcttcagtcatccatagtcactataagttggttatcatctgaaatgcttagaaccagaattgtttcaaacttggggggttttcggattttggaatatagtcaagcatggcttaaccacagggatgtgttctgagaaatgcgctgtcaggcagtttttcctgtgaacaccatgtgtacctacatggacctaaaaaacaggtggtggagcctcctccacacctaggctatatggtgtatgtagcctgttgctctagactggagggcacgttactgtactgatactgtaggcaactgttaacacaatggtatctgtgtatctgaacataacatagtaaaggtacagtgcaaa

SEQ ID NO: 139002 - DNA, 4089 bp, Homo sapiens
  Payload ID: 7237
  Gene Symbol: GRPEL2
  Gene Name: GrpE-like 2, mitochondrial (E. coli)
  Uniprot ID: Q8TAA5
  ENST ID: ENST00000329271
  CDS Start-End: 111-788
tgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttttgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaattttttttttttttcctgtgttgcccaggctgacctccaactcctgggcccaagcaatcctgcctcagcctgccaagtagctaggactacaggcgttcaccactgcgcccgcaaagtttttttgttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggtttttggtttttggtttttggttttttttttttggttggttggttgttttttacaggcggggtctcactatattgtccaggctagaagaattttctaatggtctattacacctcccgttttggcaagtaaattcagaataattttaggttcttttgttattcagtagttttgcagacttaaaagtgtaaatttagaattagaagatgaagctatagtagtaagaatctcaagctgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 139003 - DNA, 1006 bp, Homo sapiens
  Payload ID: 7237
  Gene Symbol: GRPEL2
  Gene Name: GrpE-like 2, mitochondrial (E. coli)
  Uniprot ID: Q8TAA5
  ENST ID: ENST00000416916
  CDS Start-End: 39-407
aagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaagga

SEQ ID NO: 139004 - DNA, 546 bp, Homo sapiens
  Payload ID: 7237
  Gene Symbol: GRPEL2
  Gene Name: GrpE-like 2, mitochondrial (E. coli)
  ENST ID: ENST00000513661
  CDS Start-End: 111-497
tgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggtgagagatttatttacaataaaaatgtctttggttgggcacagtggcttatgcctgtaatcccagcactttgagagtctaaggctgtcagatcacatgagatcaggattcaagaccagtctg

SEQ ID NO: 139005 - DNA, 1663 bp, Homo sapiens
  Payload ID: 7238
  Gene Symbol: GSX1
  Gene Name: GS homeobox 1
  Uniprot ID: Q9H4S2
  ENST ID: ENST00000302945
  CDS Start-End: 49-843
gtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgcagctgcatgggccccccgggccgcccgcgctgcctctactcaaggcttccttcccacccttcggctcgcagtactgccacgcgcccctgggccgccagcactctgctgtgtcgcccggggtcgctcacggcccggccgccgctgctgctgccgccgcgctctaccagacctcctacccgctgcctgaccccaggcagttccactgcatctctgtggacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgccggtggtggcgggagcgcaccgcaaggctgcaagtgcgcatcgctctcctcagccaagtgctccgaggatgacgacgaattgcccatgtctccgtcctcctcagggaaggacgaccgggatcttacggtcactccctaggcgcgtgtctccctaggtcgcccaccccaagacctccctgcgcctcggagactagtcctgggactcagcgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaactccaagctgtgaacactgtaagcgctcgagtcctcctgggcagtgcagcaccgcggcccccgcccgcaagcctgcttggcgcagcgccttgctggcagccggcgcctcctagcccgccctctctgggctggcttgggcttcctcgcttactctactctcctccgctctcggtcaaggtcggcggccttggatgctcgttcgcttctctttttaaaatgtctttttgtccctccccacctctttcctgtgatcatttattcactcggcccccgcccgccaacacacacatttatgaacccccactttttttttccttctccttttcccttcccctcctcagggagcctcctccttcagtcagtccatttgtcccttgatctggccttgctgtcctcagtccccacggctcctctcacagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaag

SEQ ID NO: 139006 - DNA, 1812 bp, Homo sapiens
  Payload ID: 7239
  Gene Symbol: GSX2
  Gene Name: GS homeobox 2
  Uniprot ID: Q9BZM3
  ENST ID: ENST00000326902
  CDS Start-End: 315-1229
gcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggaggctctgacgccagccaggtacccaatggcaagaggatgaggacggcgttcactagcacgcaactcctggagctggagagagaattctcttccaacatgtacctgtctcgactccggaggattgaaatcgccacttacctgaacctgtcggagaagcaggtgaaaatctggtttcagaaccgccgagtgaagcacaagaaggaggggaagggcacgcagaggaacagtcacgcgggctgcaagtgcgtcgggagccaggtgcactacgcgcgctccgaggatgaggactccctgtcgccggcctcagccaacgatgacaaggagatttcccccttatgagggagggcctcctccctcacatcccccgctcctggcagaccaggcaacgccaaggcgtggggcacccaggggccagaatccttgctcattgcagtggtcccatctggagaagaaacgaacctggaagttctggaatggacaagccgggacctgacccttcgcgtctccttcttgacctgtttatctaggactccaacttgaagttacagatttttttaaaaaatgtaaataacctataattcaactcattcttgtcgtataacagaggaaaaacagggttggtttaagtttaacactgtatggggtttttgaaagcacatgtcagttccccatccctactctctttcagaactcgataagaacacaggatttattgattattttctgttgtcgttttcaaacaaaaacacccaagttgaaaataatttagaaaattagaccttgtaggtcttgctttctgaaatttcgcctggggagaatttaaaatctaagtcgctggaagtccctttgtatgtgaataggtttatataaaatttatatttatatttatttaaataaatgaaacaaaaaccagaattttaaa

SEQ ID NO: 139007 - DNA, 1181 bp, Homo sapiens
  Payload ID: 7239
  Gene Symbol: GSX2
  Gene Name: GS homeobox 2
  ENST ID: ENST00000503800
  CDS Start-End: 173-577
aggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggaggctctgacgccagccaggtacccaatggcaagaggatgaggacggcgttcactagcacgcaactcctggagctggagagagaattctcttccaacatgtacctgtctcgactccggaggattgaaatcgccacttacctgaacctgtcggagaagcaggtgaaaatctggtttcagaaccgccgagtgaagcacaagaaggaggggaagggcacgcagaggaacagtcacgcgggctgcaagtgcgtcgggagccaggtgcactacgcgcgctccgaggatgaggactccctgtcgccggcctcagccaacgatgacaaggagatttcccccttatgagggagggcctcctccctcacatcccccgctcctggcagaccaggcaacgccaaggcgtggggcacccaggggccagaatccttgctcattgcagtggtcccatctggagaagaaacgaacctggaagttctggaatggacaagccgggacctgacccttcgcgtctccttcttgacctgtttatctaggactccaacttgaagttacagatttttttaaaaaatgtaaataacctataattcaactcattcttgtcgtataacagaggaaaaacagggttggtttaagtttaacactgtatgggg

SEQ ID NO: 139008 - DNA, 1262 bp, Homo sapiens
  Payload ID: 7239
  Gene Symbol: GSX2
  Gene Name: GS homeobox 2
  Uniprot ID: Q9BZM3
  ENST ID: ENST00000611459
  CDS Start-End: 315-1229
gcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggaggctctgacgccagccaggtacccaatggcaagaggatgaggacggcgttcactagcacgcaactcctggagctggagagagaattctcttccaacatgtacctgtctcgactccggaggattgaaatcgccacttacctgaacctgtcggagaagcaggtgaaaatctggtttcagaaccgccgagtgaagcacaagaaggaggggaagggcacgcagaggaacagtcacgcgggctgcaagtgcgtcgggagccaggtgcactacgcgcgctccgaggatgaggactccctgtcgccggcctcagccaacgatgacaaggagatttcccccttatgagggagggcctcctccctcacatcccccgctcct

SEQ ID NO: 139009 - DNA, 666 bp, Homo sapiens
  Payload ID: 7240
  Gene Symbol:
  Gene Name: GS1-114I9.3
  ENST ID: ENST00000442800
  CDS Start-End: 1-35
taaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggggtgataatgagaagcaatggactagaggattcaagtggaagagtcttcatcacccgtgagttctcctgggaaagtgaattggaaacaagctaagtgcattttctcagcagaaggaagatcttacacatcacctagtgaatatccagttgggaatctgaaagcagcagtgggcaggcaggggaatcaggagcaatgttcatcagtgaatgaaaggagtgctggaaagagaaccaaatgctgacatcaaagaaccttcaatcatatgattttagtgtggaaagccagatgatacactctaacatctgtgaaatcaaatcaaaatgcaaattggtttttggctttcctg

SEQ ID NO: 139010 - DNA, 830 bp, Homo sapiens
  Payload ID: 7241
  Gene Symbol:
  Gene Name: GS1-259H13.13
  ENST ID: ENST00000455905
  CDS Start-End: 121-501
ggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggttccaagagcctctgagttcctgccttttttcatctctgaatccccaccattggcctacattgggagtggggcgacctgtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccatttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggggcctgtgccttcctggctttggtgctgcatgccctggagatcaaggctctgaggatgaagctcggccccctgcagttctccgtgctgtggccttactacgtgctgggcttcggcatctttctgttcatagtggctg

SEQ ID NO: 139011 - DNA, 1596 bp, Homo sapiens
  Payload ID: 7242
  Gene Symbol:
  Gene Name: GS1-393G12.13
  ENST ID: ENST00000531225
  CDS Start-End: 1-79
tctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttaggagttctgtgtgtgtggtcctcagggtagggttgggcaacaggttatacctgatggagccactggggctacagccggcccagagcctgtgtgttgtggggtcagggtggtcccatgggctcttgagcctgcaggtggccatgcctttgcctgcccactgctgggtccagtgtgtgtgttccgtcctcggggacactggtgagcttgtctgtggttgcatgtgggtggggggtgggagggggtggggccccgcccagctgtggggctcactgagtggtcgccgcctgcaaatttctctccagctcaggcctagggtgtccacccatccacccttcacatggggactgtgaacaggccatacagggggcctccagtggatggactggccaagaagttaatgcctaccgcaggacctcaccctggactccctaagaggtggtcaacagagcagccccttctagaacctgcccagaacttctagaacccatccgcggtccaccctgggccgctccctggcctcgctgccctgtcagtcgcctgtgagctcctgctccttcctgggcctgcagccctggagaatttgctcaccgagatgcctaagggccgggccggcagcctgcccacgacctccatcggctggcgcttccagctctggttcctaggactcacctgcccggagcgccacctggccagacgcctcaagaacaatagcttctacccattcgtgcagcaggagccaaacgtcttcgtgctcgaatactacctggacacactgtggaaggggatgctgctcttcatcatcagcgtggtcctggtcagcttcagctccctgagagaggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttctcggtaacctcccagccccactctggggcagatcaaatgtgagtcccactcactggccttcctttcaataaagctgcctcagcttc

SEQ ID NO: 139012 - DNA, 7495 bp, Homo sapiens
  Payload ID: 7243
  Gene Symbol: GSE1
  Gene Name: Gse1 coiled-coil protein
  Uniprot ID: Q14687
  ENST ID: ENST00000253458
  CDS Start-End: 177-3830
tcctcggcggcgacagcagcaggtgtttcttggccggggccccggaagctccacctccccagcgggcccgagctgccgccgccgagcagccccgggtgagataagcagtttagacaaacactgggcgacggtggctccagcatgtatcagccgaggtggagctgcggggccctggcatgaaaggcatgagccatgagcccaagtccccttcgctagggatgctttccaccgcgaccaggaccaccgccaccgtcaaccccctcaccccctcgccgctcaatggcgccctggtgcccagcggcagccccgccaccagcagcgcgctgtcggcccaggccgcgccatcctccagctttgccgccgcgctgcgcaagctcgccaaacaggcggaggagcccagagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattatgtt

SEQ ID NO: 139013 - DNA, 7140 bp, Homo sapiens
  Payload ID: 7243
  Gene Symbol: GSE1
  Gene Name: Gse1 coiled-coil protein
  Uniprot ID: Q14687
  ENST ID: ENST00000393243
  CDS Start-End: 41-3475
ccagcatgtatcagccgaggtggagctgcggggccctggcatgaaagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattatgtt

SEQ ID NO: 139014 - DNA, 4366 bp, Homo sapiens
  Payload ID: 7243
  Gene Symbol: GSE1
  Gene Name: Gse1 coiled-coil protein
  Uniprot ID: Q14687
  ENST ID: ENST00000405402
  CDS Start-End: 210-3551
accgtgtggtgcgtaaattatagcgtccggccaaggccgcaaggggggcgccgccggtgagctggcgggtcgtgcggggaagcagcacccccgcgccgtgccagggccggccagcgtccgcagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttt

SEQ ID NO: 139015 - DNA, 6625 bp, Homo sapiens
  Payload ID: 7243
  Gene Symbol: GSE1
  Gene Name: Gse1 coiled-coil protein
  ENST ID: ENST00000412692
  CDS Start-End: 1-2960
cccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattatgtt

SEQ ID NO: 139016 - DNA, 872 bp, Homo sapiens
  Payload ID: 7243
  Gene Symbol: GSE1
  Gene Name: Gse1 coiled-coil protein
  ENST ID: ENST00000411612
  CDS Start-End: 241-872
gtcagggagccgggagcgagccagtggcccgggagtgggcggcgttgcgtttgggtgtgtcctcggcggcgacagcagcaggtgtttcttggccggggccccggaagctccacctccccagcgggcccgagctgccgccgccgagcagccccggggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccct

SEQ ID NO: 139017 - DNA, 1741 bp, Homo sapiens
  Payload ID: 7243
  Gene Symbol: GSE1
  Gene Name: Gse1 coiled-coil protein
  ENST ID: ENST00000438180
  CDS Start-End: 1-1259
ttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcgatggggtttccccatgttggccaggctggtctcgaactcctgacgacaggtgatctgcccgcctcgacctccaaaagtgctgggattacaggcgtgagccaccacgcccggccgggacattttcaaatgagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatc

SEQ ID NO: 139018 - DNA, 1173 bp, Homo sapiens
  Payload ID: 7244
  Gene Symbol: GSG1L
  Gene Name: GSG1-like
  Uniprot ID: Q6UXU4
  ENST ID: ENST00000380897
  CDS Start-End: 167-697
ggcagctgagtcagtgagcagcgccatgatgaggggcagtccctgccagcaccaacaggggctggaaacccagcgataggagcatcagcatctccgaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgt

SEQ ID NO: 139019 - DNA, 1399 bp, Homo sapiens
  Payload ID: 7244
  Gene Symbol: GSG1L
  Gene Name: GSG1-like
  Uniprot ID: Q6UXU4
  ENST ID: ENST00000395724
  CDS Start-End: 78-920
tgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgtttt

SEQ ID NO: 139020 - DNA, 4916 bp, Homo sapiens
  Payload ID: 7244
  Gene Symbol: GSG1L
  Gene Name: GSG1-like
  Uniprot ID: Q6UXU4
  ENST ID: ENST00000447459
  CDS Start-End: 86-1081
gcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgttttcttgcggtgtatggaggccagttgctctgtgggctgtggctgccctgtcattgccccaccccattactcctcaaggaggctgaaggtgacagcagagactgtgcagaggccagggccagacactgcagggtggcagggagggagcacagagcccaggctggacacaggctggcagggctgccttgtattccagagagtgggcaaggcaggggccaggcaagcaagagatgtggggcgagcaagaagtgggcccccaaacccaagccctaagcagggagggtgaagaagccacatttctcttcagagctcagcaacatcacaccaccctgaccctgaggaggctttaccctgtgcctagcaccacctttacagaaaatcccagggcttagatgcctggagaaacagattcttattataaagaggaggaaaattagggtcacagagatgaatgaagtaacttgcctgtgattacagagctagcaaatggcagagatggggtttgaatcaggactcctgactccaagttcagtcatttcccaagaggccttattccttcccagaagaatttctagagcttttccccacgtagaatatattcttctcctttatccttccatccttccatccatcatccatcactcatccagccattatccattatccatccatccattcatcattcgtccatctattatccacccattcatcatctattatccatccatcattcatcatccatccatcattcataattcatctttccactcatccatccatcattcattcattcatccatccttccatccatccatcatctatccattcatccatccatttgccatccatccactcattcatcagctatccatcatctatccatccatccatccatccagcatctatcactcatccagctattgtccattgtccattcatccatttttcattcatccctccatcatcattaatccattatccacccactcatcatctattatccatctatagtccatcaaccatccatccttcatcatccatccatccatccttcatccatccatccacccatccatccatccatcatctgtccatccattatctatccattcatccatccattcatcatccacccacctattcatcagctatctatccatcatccatccatccatcatccatccatccatccatccatccatcatctatccattcattgtctatgctttcatccatccattcatcatccatccacccattcgttagctatttatccattatccattcctccatctatccatcatccattcatcccttatccattcaaccattatgcatttcttcatttatccattatttatccttccatccatcatccatcatctttccatccactatctatccattcatccatctatccatcatccatccatcctttatccatcattcatcagccatcatccctccatctatccattatccatcatccactcatccattcatccctccatctgcccattatccatcaaccatccatccatccattatccgtcatccacacatccattcatccctccatctgcccattatccatcaaccatccatccatccattatccatttctgcattatccatttattctttatccatttcttcatctattcatcatctatccatccattatccttacacctatctatcatccatccattccttcatctatccatcatccatcaattatccatccattcatccatccatctatccatcttctattgattgcttgtcatccttccttgtatcagacttccatccatcctccttccatgtgtcacacatcctcattactcaaccatccagctgtgcatccatctattcactgatatagttcactgtgcccctactatgtgccaagcactgtggtaggcacttgaggtgggatgctggagcatccagagagggcatctattgtcgtgagcctgggttcagattccaccttctccacttgtgaccttgggcgagttacttgacctttctgtgcctgtttcctcatccattaaatccggataatcattatacctacctcttcaagctgttgtgcaaattaaatgagctaacatatttgaagtgtctagaacagagcctggcacaagtaaacactttgtgggtgtttactaacaggacaacaaggggaaatcggggctgtgggagctgtagtctagggaggctcctttgagaaaatgatgtctaagccaagacatgaagattgtctgggcatcagccaggcaagagtatagcagggaaagaaagtacattagaggactttaaaatagtcccaatggcaggtgtggagagcagggaggtcaggaggcagttgtgggaaattaggcatcagagggcagtggagccaggccaggaggaactggaaaccttcttagggagcttagagtttaccctggggcaatggggagtgggcagtgagatgcttttagcagactgggatgcgcctgggtgtacatttgaggaagatcaccgcaactatgggcacagaatagttgtgggagatgcttctcccttcctcatccctcttacactcaagaaagagaagaaagtgggctggcttaggaaagttgccctggggaggggaccatgcgggcagattcaggaaccaattaggagggaatagactgagtgggagaagaggaaagttggtgacgactctcaggttacagggtcagcttgggggatagggaagacggagacttcgtggttcagatgtcttgagtctcaggggctcaggggacagccagctggaggtttgtgctcattcattcacgcattgattcatcaagcgaacaatttgttaattcactttccattcattcagtaaatattaatgacctactaggtggggcttaaggcggggctggaaatgggcctgggagagcaattatggtccagctctactgaggccttgaatgtcagaacaaggaatttgggctttggcctcatgcaagagagggcggctgccatatatgggcctgggcagggacagatctgacagggatctagccctggccaccaggcatctaggagctcttgttctcacccagggtccttctgaagttggcgagtggaccgcaggaggtccaggagatgattgtagttgacacatggggaaaattttaatctattttaatagttgtgtttatgtaaatgtgtattagaaaaaaatgtacagtgggcacatcagtgctatgacttcacagacgttactgcttaggatgaaaccaaaataggcatttaagtaaaagaaaaaaagagttggcttaaagaaaaatattaaataaataatcgtg

SEQ ID NO: 139021 - DNA, 585 bp, Homo sapiens
  Payload ID: 7244
  Gene Symbol: GSG1L
  Gene Name: GSG1-like
  Uniprot ID: Q6UXU4
  ENST ID: ENST00000569166
  CDS Start-End: 1-585
atgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtggcaaatcgaggcacagagagggagggcgacttgccccaggtcacacagctggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtga

SEQ ID NO: 139022 - DNA, 779 bp, Homo sapiens
  Payload ID: 7244
  Gene Symbol: GSG1L
  Gene Name: GSG1-like
  ENST ID: ENST00000562611
  CDS Start-End: 1-529
cggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcagttgaagactccacgctggttttccctcagcctccctggccactctgcctcagctttctttgctggtccctcctgctctgcttaatatcagatgttggcttcatcctgggacccttctctctcctcttcctacagtctctctccaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtggcaaatcgaggcacagagagggagggcgacttgcccc

SEQ ID NO: 139023 - DNA, 882 bp, Homo sapiens
  Payload ID: 7245
  Gene Symbol: GSG1L2
  Gene Name: GSG1-like 2
  Uniprot ID: A8MUP6
  ENST ID: ENST00000399363
  CDS Start-End: 1-882
atggacagggccaagcagcagcaggcgctgctcctcctccctgtctgcctcgccctcaccttctccctcaccgccgtggtcagcagccactggtgtgaggggacccgacgggtggtgaagccactgtgccaggaccagccgggagggcagcactgcattcacttcaaacgggacaacagcagcaatggcaggatggacaacaatagccaggctgtcctgtacatttgggagctgggtgatgacaagttcattcagcgggggttccatgtggggctctggcagtcctgcgaggagagcctcaacggtgaagatgaaaagtgtaggagtttccggagtgtagtgccagctgaagaacaaggtgttttgtggctgtccatcgggggcgaggtcctggatatcgttctgatactgacaagcgccatcctcctgggctccagagtgagttgtcgcagccctgggttccactggctcagggtggatgccttggtagccatcttcatggtgctggcagggcttctaggcatggtggcccacatgatgtacacaaccatttttcaaatcactgtgaaccttggaccagaagattggaagcctcagacctgggactatggctggtcatattgccttgcctggggttctttcgccctctgcctggctgtgtcggtctcggccatgagcaggttcacggcagcccgcctggaattcaccgagaagcagcaggcacagaacggcagtcggcactctcaacacagcttcctggaacccgaggcttcggagagcatttggaaaacaggagctgctccttgccctgctgaacaagccttcaggaatgtttctggacacctcccaccaggcgccccaggcaaggtgtccatatgctag

SEQ ID NO: 139024 - DNA, 2140 bp, Homo sapiens
  Payload ID: 7246
  Gene Symbol: GSKIP
  Gene Name: GSK3B interacting protein
  Uniprot ID: Q9P0R6
  ENST ID: ENST00000438650
  CDS Start-End: 119-538
ggagcagttccggctccgagggggcggggcggaagaaggcggggagggagggggcggcaccgccggtcggctccagtcgcctccggaggaaggaagaagaggacgccgggcgcgcagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattcc

SEQ ID NO: 139025 - DNA, 2218 bp, Homo sapiens
  Payload ID: 7246
  Gene Symbol: GSKIP
  Gene Name: GSK3B interacting protein
  Uniprot ID: Q9P0R6
  ENST ID: ENST00000555181
  CDS Start-End: 195-614
ggggcggaagaaggcggggagggagggggcggcaccgccggtcggctccagtcgcctccggaggaaggaagaagaggacgccgggcgcgcagctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaa

SEQ ID NO: 139026 - DNA, 501 bp, Homo sapiens
  Payload ID: 7246
  Gene Symbol: GSKIP
  Gene Name: GSK3B interacting protein
  ENST ID: ENST00000553699
  CDS Start-End: 268-501
agtcgcctccggaggaaggaagaagaggacgccgggcgcgcagcatcatgcttgggctagtggccccatctcaacatggctacttggaacagcttgagctgtgtgctgtgactgaactaatctgattaaagtgaccaagaagtccgggcgcagtggttcatgcctctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgccta

SEQ ID NO: 139027 - DNA, 3834 bp, Homo sapiens
  Payload ID: 7246
  Gene Symbol: GSKIP
  Gene Name: GSK3B interacting protein
  Uniprot ID: Q9P0R6
  ENST ID: ENST00000556095
  CDS Start-End: 1813-2232
ccgggcgcgcaggtgagcggcagccggggtggctgcgggcgaggggcggcccccgagaagggctaggggctcggggcgccggcgggccgtcaggccttccggatggggacgcgacgccatgcagctggctgggccgagaggggcggcaggctgcaggggccccgcgcccgtgttaagaggggtctgggggccggtctggccggcctggctctcccggctcccctcagacctcggcgccccggaaacgcacacttggggctccgccgtctccgctgggaggactggagcccttctcgagcatccccgcccgcacccgagcattgaccggtgcccattgtcagcaagttcttcggcccccgcctcattcaggtattgtttctgaggcagcttcttcgttgccgtttgcctggcggtttgcagagcgcttctcgcatacgctcgcttaatcctgggtgtgtcatagcaacgatcaggaaacttgggttttcgaagcatctgtgggcaaaactgcattccttgagaaatgctaaaggctcctgaccccgccggaacctgggtgaagaacttgggctgttctggcagtctgcgcaatcgtatttctgccttttgggaggtaactcctgcagaggcggagccggctgttaagttaagtcaacctcgaaaggcctgggtgcgggtgttctatggcccagaagccagatgtccttcgttagaatcccggcactgacacctattagccgcccagccactttgagcggccactgccctccccgagcccacgttgcctcctttgccgagtgtgagcggattaaaatcttatgtgcatggatttgttgggaagattaaatgatatgagtagggcacgaacctgaacagagtcctgaaacatacagctgtttaatcacagtgaattaagacgaccagtttaaggagtgaaatgtttactgtctcggcaactttcatgaatgccttggaaatacagcccaaaatattggtagatggagaaacatctggttcccctttccacaaccaccttttcgttttagaaccagggtactttgtatgcagttgcttggattgttgatttccctcattctttgtagactcatctcaagtattctcagtaacttagattcccttgctcttcattcagaaatatttgttaaggtccattaaatgaaagtcaccacagttgatcatgtgaacagtgtcaagaatcaggccgaaccttcaaggagtttatgttctaaaacggaagcatggtggtacctgcttgtggaggctgaggcggaaggatcgcttgagcccaggactttgaggctgcataattgcattgacgctatccatagagtgcctgcaatttcaaatatcagaaaggatcgtacgagctatgatcatgccactgcactccagcctgaaccacagagcaagaccctttctctcaataaagtggaagtttgttcatttattcagtaaatatttattgattgccttctgtgtgccaagcactgttctaggtactgggattacagcagtgaacagataaatctcttccttcctggaacttacattttattgaagggaggagacatacaataaatgagtgaataatatgctttgtggtgataagggctgttggaaaaacgaaagcaatgtaaagggagtggagatggggaagagagaagggacttgccatttttatatgagatgctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattcc

SEQ ID NO: 139028 - DNA, 760 bp, Homo sapiens
  Payload ID: 7246
  Gene Symbol: GSKIP
  Gene Name: GSK3B interacting protein
  Uniprot ID: Q9P0R6
  ENST ID: ENST00000554182
  CDS Start-End: 113-532
agtcgcctccggaggaaggaagaagaggacgccgggcgcgcagctcggtgctgattatcacaactgtttggtgacctacttcactgacctgtgaggattccttcccttcagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattca

SEQ ID NO: 139029 - DNA, 361 bp, Homo sapiens
  Payload ID: 7246
  Gene Symbol: GSKIP
  Gene Name: GSK3B interacting protein
  ENST ID: ENST00000555757
  CDS Start-End: 35-361
tcacaactgtttggtgacctacttcactgacctaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactcc

SEQ ID NO: 139030 - DNA, 1803 bp, Homo sapiens
  Payload ID: 7247
  Gene Symbol: GTF2H2C
  Gene Name: GTF2H2 family member C
  Uniprot ID: Q6P1K8
  ENST ID: ENST00000380729
  CDS Start-End: 289-1476
gtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 139031 - DNA, 1956 bp, Homo sapiens
  Payload ID: 7247
  Gene Symbol: GTF2H2C
  Gene Name: GTF2H2 family member C
  ENST ID: ENST00000446221
  CDS Start-End: 144-299
gactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccgaga

SEQ ID NO: 139032 - DNA, 610 bp, Homo sapiens
  Payload ID: 7247
  Gene Symbol: GTF2H2C
  Gene Name: GTF2H2 family member C
  ENST ID: ENST00000514162
  CDS Start-End: 191-562
gtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggtgtttgattccagcatgtagtatacattgtatgtgttaaaaagaaatttgcaact

SEQ ID NO: 139033 - DNA, 2952 bp, Homo sapiens
  Payload ID: 7247
  Gene Symbol: GTF2H2C
  Gene Name: GTF2H2 family member C
  Uniprot ID: Q6P1K8
  ENST ID: ENST00000510979
  CDS Start-End: 196-1383
ggtgagtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccgagattgtgccactgcactccaccctagagtaagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcctgtaatcctagcactttgggaggccgaggcgggcagatcacgaggtcaggagatcgagaccatcctggctaacacggtgaaaccccgtct

SEQ ID NO: 139034 - DNA, 583 bp, Homo sapiens
  Payload ID: 7247
  Gene Symbol: GTF2H2C
  Gene Name: GTF2H2 family member C
  ENST ID: ENST00000514069
  CDS Start-End: 166-321
gagtttccggctgagagtccttctagcggcgccggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaat

SEQ ID NO: 139035 - DNA, 832 bp, Homo sapiens
  Payload ID: 7247
  Gene Symbol: GTF2H2C
  Gene Name: GTF2H2 family member C
  ENST ID: ENST00000512736
  CDS Start-End: 69-566
tgagtttccggctgagagtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaagttagtattatacattatgtataattgaattagaagttttttaaatgagttaagttgaagtgatgtgttaatatggggcccataaacccagctataacaaaattgttaagtacgagaattatgtagtgttatttatgatgtttagtgtggtgttggttagtaatttttattttacattttagtaagatattgttaaaggttttataaaaatataatttaaaactgtcggcagtatcaatagtacaaaaataggttgatgaaaaaatattttattaaaatgagatttaatatagt

SEQ ID NO: 139036 - DNA, 769 bp, Homo sapiens
  Payload ID: 7247
  Gene Symbol: GTF2H2C
  Gene Name: GTF2H2 family member C
  ENST ID: ENST00000506129
  CDS Start-End: 52-330
gtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgca

SEQ ID NO: 139037 - DNA, 772 bp, Homo sapiens
  Payload ID: 7247
  Gene Symbol: GTF2H2C
  Gene Name: GTF2H2 family member C
  ENST ID: ENST00000507595
  CDS Start-End: 12-772
ttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctcttt

SEQ ID NO: 139038 - DNA, 1872 bp, Homo sapiens
  Payload ID: 7247
  Gene Symbol: GTF2H2C
  Gene Name: GTF2H2 family member C
  ENST ID: ENST00000511629
  CDS Start-End: 54-209
gagtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcagatggagtcttgctctgtcgccaggctagagtgcagtggcacaatttcggatcactgcaaagtccgcctcacgggttcaagcgattccctgcctcagcctcctgagtagctggaactacagatgcccgccaccacgccctgctaattttttgtattttagtagatacggggtttcaccatgttggccagtatggtctcaatctcttgaccttgtgatcagcccgcctcagcctctcaaagtgctgggattacaggcttgagccaccgcatccggccttatcctgaagatattaaaatacagttattgtaatcatttataaaatccagttaatcttaaaattaaattcttaaaaagttaagcatctaatttaaaagggaaaaagtataaaaattaaactgtagctattgctaatgaatcaatttttctgcttccatgacatacctaactgaattttagtttcaaaacgtagtaatggcattttttatttgctttgatatatatgctgttacaaatttgcatcactgattctattttattttctgtgaaatacactctcccttaaatctggttttcaaccttttatccttgccggcacacataagggaaatgacatactttcttcattagtagtttttcattaaatgcagtgaggagtgaaatgtacattggcctggagtgattcaagaaactcagttgtgagtaaccaaaagaatgtcacactagcttaagtgcagaaggaaaattttgggctatgttcaaaggtgggccaattccatatatagttgctgcatatgttggggtcctggctttgtctggcttcattctctgatagattttctggaagttgaaaagatgtctcttaattgtcccagttctacattgtacccgtagcctatagcttcagcacacgtctagggagaactctgattggcctgagttacgatctgcccatccatgaacaaagtggccaggaaatgaagtattttgtttgtacgcttcgattgcctgctgatgcccagagcaggatagaagtagggtcagcaccacatgaactaagcaggattattatatagtggaagaaggatggttcctccaaggtaggaatataaggtcaatattttcctctcactttacccaccccgagttaccagcagttttctattgcttcttttttttttttttgagaaggagtctctcactctgtcgcccaggcggtgctgtcttggctcactgcaacctccgcctcccgggttcaagagattctcctgcctccccctcccgagtagctgggattacaggtgtgcgctgccacacctggctaattttatttttagtagagacaggatttcaccatgctggccaggctgatctcgaactcctgacctcaggtgatctacccacctcagcctcccaaagtgttgggattacaggcatcagccaccatgcccggccccagcagttttctatggatgttagtgaagtcatgtataaa

SEQ ID NO: 139039 - DNA, 1686 bp, Homo sapiens
  Payload ID: 7248
  Gene Symbol: GTF2H2C_2
  Gene Name: GTF2H2 family member C, copy 2
  Uniprot ID: Q6P1K8
  ENST ID: ENST00000621406
  CDS Start-End: 169-1356
ggcgcagaggtggggcaggccgtctgactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatttaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatga

SEQ ID NO: 139040 - DNA, 830 bp, Homo sapiens
  Payload ID: 7248
  Gene Symbol: GTF2H2C_2
  Gene Name: GTF2H2 family member C, copy 2
  ENST ID: ENST00000612211
  CDS Start-End: 68-565
gagtttccggctgagagtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaagttagtattatacattatgtataattgaattagaagttttttaaatgagttaagttgaagtgatgtgttaatatggggcccataaacccagctataacaaaattgttaagtacgagaattatgtagtgttatttatgatgtttagtgtggtgttggttagtaatttttattttacattttagtaagatattgttaaaggttttataaaaatataatttaaaactgtcggcagtatcaatagtacaaaaataggttgatgaaaaaatattttattaaaatgagatttaatatag

SEQ ID NO: 139041 - DNA, 1956 bp, Homo sapiens
  Payload ID: 7248
  Gene Symbol: GTF2H2C_2
  Gene Name: GTF2H2 family member C, copy 2
  ENST ID: ENST00000619880
  CDS Start-End: 144-299
gactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatttaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccgaga

SEQ ID NO: 139042 - DNA, 1873 bp, Homo sapiens
  Payload ID: 7248
  Gene Symbol: GTF2H2C_2
  Gene Name: GTF2H2 family member C, copy 2
  ENST ID: ENST00000612324
  CDS Start-End: 54-209
gagtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcagatggagtcttgctctgtcgccaggctagagtgcagtggcacaatttcggatcactgcaaagtccgcctcacgggttcaagcgattccctgcctcagcctcctgagtagctggaactacagatgcccgccaccacgccctgctaattttttgtattttagtagatacggggtttcaccatgttggccagtatggtctcaatctcttgaccttgtgatcagcccgcctcagcctctcaaagtgctgggattacaggcttgagccaccgcatccggccttatcctgaaaatattaaaatacagttattgtaatcatttataaaatccagttaatcttaaaattaaattcttaaaaagttaagcatctaatttaaaagggaaaaagtataaaaattaaactgtagctattgctaatgaatcaatttttctgcttccatgacatacctaactgaattttagtttcaaaacgtagtaatggcattttttatttgctttggtatatatgctgttacaaatttgcatcactgattctattttattttctgtgaaatacactctcccttaaatctggttttcaaccttttatccttgccggcacacataagggaaatgacatactttcttcattagtagtttttcattaaatgcagtgaggagtgaaatgtacattggcctggagtgattcaagaaactcagttgtgagtaaccaaaagaatgtcacactagcttaagtgcagaaggaaaattttgggctatgttcaaaggtgggccaattccatatatagttgctgcatatgttggggtcctggctttgtctggcttcattctctgatagattttctggaagttgaaaagatgtctcttaattgtcccagttctacattgtacccgtagcctatagcttcagcacacgtctagggagaactctgattggcctgagttacgatctgcccatccatgaacaaagtggccaggaaatgaagtattttgtttgtacgcttcgattgcctgctgatgcccagagcaggatagaagtagggtcagcaccacatgaactaagcaggattattatatagtggaagaaggatggttcctccaaggtaggaatataaggtcaatattttcctctcactttacccaccccgagttaccagcagttttctattgcttctttttttttttttttgagaaggagtctctcactctgtcgcccaggcggtgctgtcttggctcactgcaacctccgcctcccgggttcaagagattctcctgcctccccctcccgagtagctgggattacaggtgtgcgctgccacacctggctaattttatttttagtagagacaggatttcaccatgctggccaggctgatctcgaactcctgacctcaggtgatctacccacctcagcctcccaaagtgttgggattacaggcatcagccaccatgcccggccccagcagttttctatggatgttagtgaagtcatgtataaa

SEQ ID NO: 139043 - DNA, 1803 bp, Homo sapiens
  Payload ID: 7248
  Gene Symbol: GTF2H2C_2
  Gene Name: GTF2H2 family member C, copy 2
  Uniprot ID: Q6P1K8
  ENST ID: ENST00000619699
  CDS Start-End: 289-1476
gtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatttaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 139044 - DNA, 3430 bp, Homo sapiens
  Payload ID: 7249
  Gene Symbol: GTF2IRD1
  Gene Name: GTF2I repeat domain containing 1
  Uniprot ID: Q9UHL9
  ENST ID: ENST00000265755
  CDS Start-End: 394-3273
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaaggaactgcctcctcacttggcttctctccccctgccctgcccccagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaa

SEQ ID NO: 139045 - DNA, 3315 bp, Homo sapiens
  Payload ID: 7249
  Gene Symbol: GTF2IRD1
  Gene Name: GTF2I repeat domain containing 1
  Uniprot ID: Q9UHL9
  ENST ID: ENST00000455841
  CDS Start-End: 214-3144
gccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgcctctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaaaaa

SEQ ID NO: 139046 - DNA, 3077 bp, Homo sapiens
  Payload ID: 7249
  Gene Symbol: GTF2IRD1
  Gene Name: GTF2I repeat domain containing 1
  Uniprot ID: Q9UHL9
  ENST ID: ENST00000424337
  CDS Start-End: 75-2909
gaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaa

SEQ ID NO: 139047 - DNA, 824 bp, Homo sapiens
  Payload ID: 7249
  Gene Symbol: GTF2IRD1
  Gene Name: GTF2I repeat domain containing 1
  ENST ID: ENST00000470715
  CDS Start-End: 1-824
tccggcccctgcggaagcaggtggagctgctcttcaacacacgatacggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcct

SEQ ID NO: 139048 - DNA, 5868 bp, Homo sapiens
  Payload ID: 7249
  Gene Symbol: GTF2IRD1
  Gene Name: GTF2I repeat domain containing 1
  ENST ID: ENST00000476977
  CDS Start-End: 1692-4574
aacatttagcagcaaactcaacatacattttggccaaacgcccaccggccagttgtttaaatcaatatttatccacagccaaaaagcagaggagagccagaactgaggccagagccgagctctgatgcatctctcatttctcgggatgtttctgtccctgtggttggacacctctggccttgtgaagtgtgatgcactgtcacatctcctgttctgtgtcattggccaatgatcatatatcatgacctgctggaaggcctgtctgtggctgggaccacacgccttgggccttatgcacactgggcactggtcgggatcctggggtgcaacagtggcaggcagacctggtttctgccctcaaagagcttacagatggcaggggcacccatggcggcagaagacaccccaggcctggtgccctttgtggtgccagccccatggtcctcctgcctgggccttccctaccccattgggtgcagaaactccctgtctgcaggtaggagacagagggtaggttttcaggctcccttgggaactgcagccctgctctctgccatcaacacccagcaggggccacacagagagcaccgggactgagcccatagaggggaaccgagaggcccctgcctctagtctctgccttctttgcttggattggtgcagggacagctgccttgagggcaggccctggcactggggcagcctgtgggtgccccctgggtcaagaaggagaggggcagggtagaaccaggagccaaaggaggctgatctttgcatctcatgggtgcccagctggacactgtcatacccaggaagcctgtgccatgccatggggacccacaactgggggccctggacttgagggggaggatgcagctctgtcccccaggaaccccattgcaacaggacacagtcctgccctggggagcccctgacctgagacaaagcagcctcggccctgctgtatctttccatacccctgatgccaagtctcctggctaggagggaaactgaggctggaaggcctcggcgggggtggcattggcctcgggagcatgtggcttgatgcagaaatgtgacggcagagctcagaggcatgcggaagggaggggaggacatcaccggctcctgacccagctgggcttcaggttgggggtacaggaggtgggcaagcaggttggacaattaaaagcttcgatgaggctgggtgagtggcttatgcctgtatttccaacactttgggaggctgaggtgggcagatcacctgaggccaggagttcaagaccagcctggccaacatggtgaaaccccatctctactaaaaatacaaaaattagccagacgtgtggtggcacctgtaatcccagctacccgggaggctgaggcaggagaatcactcgaacccaggaaggggaggttgcagtgagccaagattgcaccactgcactatagcctgggcaacagagtgagactctgtctcgaaataaaattaaatttaaaatttaaaaaagcttcaaggacaaccagcagatgatggcaggaccaggaagggtgcttcaggcagcgggaactgaacctgcacagactagggaagcatgaacatcggtacatctgggagtggcacagcttagagggcctggagcatggagtgtgagggggaactggagtgagggacaggagaccaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagactccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactccatctcaaaaaaataaaaaatataaataaatagcctctgagaaagctcttccaaaagcagaactaagcattttgggtttgttccgcatcacctggagtcctaatccagtccctttgtccctctctctagcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaag

SEQ ID NO: 139049 - DNA, 3558 bp, Homo sapiens
  Payload ID: 7250
  Gene Symbol: GTF2IRD2
  Gene Name: GTF2I repeat domain containing 2
  ENST ID: ENST00000451013
  CDS Start-End: 191-3040
gggaaagaaagaaagagaaaaaggagggcgagtggcgagcaggggcttcggccgccacccacacgccccgaagcgtgctcgtcccccgcgcggggctctcggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcaggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggctcatcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaaaagcctgaaaaacttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactccagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaatttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcctggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaacttttttttttttcagttttttttccactttgaatcagaaatataatctgcagtatcatacttgtttatattacattgtatgcctcactattcattaaaaatcaagaaagttttattgta

SEQ ID NO: 139050 - DNA, 578 bp, Homo sapiens
  Payload ID: 7250
  Gene Symbol: GTF2IRD2
  Gene Name: GTF2I repeat domain containing 2
  Uniprot ID: Q86UP8
  ENST ID: ENST00000614386
  CDS Start-End: 169-495
ggagggcgagtggcgagcaggggcttcggccgccacccacacgccccgaagcgtgctcgtcccccgcgcggggctctcggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgtaggtgttttaattttatcctttgtattcccaatctcaaaaggatcgcaggcaagacttccacagtattttcttctaagctatcataagcattctcctagaaacgatcctaacacatcttcttggattcagcttaccaaataaacactgcttaacactgcagagtccaaga

SEQ ID NO: 139051 - DNA, 1910 bp, Homo sapiens
  Payload ID: 7250
  Gene Symbol: GTF2IRD2
  Gene Name: GTF2I repeat domain containing 2
  ENST ID: ENST00000625377
  CDS Start-End: 180-1673
aaagagaaaaaggagggcgagtggcgagcaggggcttcggccgccacccacacgccccgaagcgtgctcgtcccccgcgcggggctctcggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcaggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggacttttggaggccaaggcaagaggattgcttgaggccaggagtttgagaccagcctgggcaacacaagaccccatctctacaaaaaatttaaaaattagctggaaacagtggctcacacctgtagccccagctacttggcaggctaaagcaggaggatcacttaaactcaggagtttgagacagcagagaaccataattgcaatactacactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctct

SEQ ID NO: 139052 - DNA, 3485 bp, Homo sapiens
  Payload ID: 7251
  Gene Symbol: GTF2IRD2B
  Gene Name: GTF2I repeat domain containing 2B
  Uniprot ID: Q6EKJ0
  ENST ID: ENST00000418185
  CDS Start-End: 160-840
gtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaaggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatacggaaagaatgcgtgacgagaagcttcacgagctgaaaaaagggctcaggaagtatctcttaggctcgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaattttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcatgcgccaccatgcccggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaactttttttttttttcagttttttttccactttgaatcagaaatataatctgcagtatcatacttgtttatattacattgtatgcctcactattcattaaaaatcaagaaagttttattgta

SEQ ID NO: 139053 - DNA, 1932 bp, Homo sapiens
  Payload ID: 7251
  Gene Symbol: GTF2IRD2B
  Gene Name: GTF2I repeat domain containing 2B
  ENST ID: ENST00000619142
  CDS Start-End: 180-1493
aaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggacttttggaggccaaggcaagaggattgcttgaggccaggagtttgagaccagcctgggcaacatagcaagaccccatctctacaaaaaatttaaaaattagctggaaacagtggctcacacctgtagccccagctacttggcaggctaaagcaggaggatcacttaaactcaggagtttgagacagcagagaaccataattgcaatactacactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctctacaaaaaaaagaaaaagaa

SEQ ID NO: 139054 - DNA, 3560 bp, Homo sapiens
  Payload ID: 7251
  Gene Symbol: GTF2IRD2B
  Gene Name: GTF2I repeat domain containing 2B
  Uniprot ID: Q6EKJ0
  ENST ID: ENST00000472837
  CDS Start-End: 191-3040
gggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatacggaaagaatgcgtgacgagaagcttcacgagctgaaaaaagggctcaggaagtatctcttaggctcgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaattttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcatgcgccaccatgcccggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaactttttttttttttcagttttttttccactttgaatcagaaatataatctgcagtatcatacttgtttatattacattgtatgcctcactattcattaaaaatcaagaaagttttattgta

SEQ ID NO: 139055 - DNA, 573 bp, Homo sapiens
  Payload ID: 7251
  Gene Symbol: GTF2IRD2B
  Gene Name: GTF2I repeat domain containing 2B
  ENST ID: ENST00000614064
  CDS Start-End: 172-498
aaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgtaggtgttttaattttatcctttgtattcccaatctcaaaaggatcgcaggcaagacttccacagtattttcttctaagctatcataagcattctcctagaaacgatcctaacacatcttcttggattcagcttaccaaataaatactgcctaacactgcaga

SEQ ID NO: 139056 - DNA, 1910 bp, Homo sapiens
  Payload ID: 7251
  Gene Symbol: GTF2IRD2B
  Gene Name: GTF2I repeat domain containing 2B
  ENST ID: ENST00000629105
  CDS Start-End: 180-1673
aaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggacttttggaggccaaggcaagaggattgcttgaggccaggagtttgagaccagcctgggcaacacaagaccccatctctacaaaaaatttaaaaattagctggaaacagtggctcacacctgtagccccagctacttggcaggctaaagcaggaggatcacttaaactcaggagtttgagacagcagagaaccataattgcaatactacactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctct

SEQ ID NO: 139057 - DNA, 5126 bp, Homo sapiens
  Payload ID: 7252
  Gene Symbol: GTPBP1
  Gene Name: GTP binding protein 1
  Uniprot ID: O00178
  ENST ID: ENST00000216044
  CDS Start-End: 234-2243
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctccaa

SEQ ID NO: 139058 - DNA, 1350 bp, Homo sapiens
  Payload ID: 7252
  Gene Symbol: GTPBP1
  Gene Name: GTP binding protein 1
  ENST ID: ENST00000458073
  CDS Start-End: 1-1050
ctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaagtcacaggtccaaggggcaaatagcgaattcccatggaggagaatcactgcactccaagtggacgtggctggtaggatgggaagcagacgccacgggcacagagggaaggaagaagggagctgctggagcctgctaaccgcctcgagccacctgctgctcaggagaccctgcccgtccttttcatctgcatggggccacaggctcctctcttgtgctcctagaagtcagagcgccgagcaagcgtgtgggggaagcggcggggtgctgttcacccactcccagatggctggcagcaggcaccagaagcttccctcatgctgcccttctggaaggtgccttcccctgtgctgacgtctgcaggatgcgtgttacaccccatttggatatcacatcttgagctgtgggaaaggagagcagggcttccctctctgaaccccatgcctggcagggtaagtgcccagggagcacctgctgcctggatggggagtctgcgccacttctgctagcacagcagcatcccgtacctgaaagtgaaacgtctgaataggctcgccgtcctgatcgtaagtgaacttgccaaggagtgtcccctcctgctgcaggtcttcgtcaaacccctgcaaagagagcggagggaagtggggaggggct

SEQ ID NO: 139059 - DNA, 810 bp, Homo sapiens
  Payload ID: 7252
  Gene Symbol: GTPBP1
  Gene Name: GTP binding protein 1
  ENST ID: ENST00000418601
  CDS Start-End: 8-220
attaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtg

SEQ ID NO: 139060 - DNA, 418 bp, Homo sapiens
  Payload ID: 7252
  Gene Symbol: GTPBP1
  Gene Name: GTP binding protein 1
  ENST ID: ENST00000489527
  CDS Start-End: 1-122
cacaggtccaaggggcaaatagcgaattcccatggaggagaatcactgcactccaagtggacgtggctggtaggaagcttccctcatgctgcccttctggaaggtgccttcccctgtgctgacgtctgcaggatgcgtgttacaccccatttggatatcacatcttgagctgtgggaaaggagagcagggcttccctctctgaaccccatgcctggcagggtaagtgcccagggagcacctgctgcctggatggggagtctgcgccacttctgctagcacagcagcatcccgtacctgaaagtgaaacgtctgaataggctcgccgtcctgatcgtaagtgaacttgccaaggagtgtcccctcctgctgcaggtcttcgtcaaacccctgcaaagagagcggagggaagtggggagg

SEQ ID NO: 139061 - DNA, 582 bp, Homo sapiens
  Payload ID: 7252
  Gene Symbol: GTPBP1
  Gene Name: GTP binding protein 1
  ENST ID: ENST00000488787
  CDS Start-End: 323-582
acttgaggggattcggagaccgagagtctcctctccctggaccgcgcgggacagcagaggggcgagggggcccgggcagggggccgagacgctcatgaagacaggtagtcggaggccagggcagggtggccgccgcgtctcttcccagactcgggaaaggaaacagaaagtagtcgctcagctggggaggagcatgtccgagaatgtctacttttcgaggccacccgaaacaaaatggaaagatggtcaggctccttagtctcgctatcctctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaa

SEQ ID NO: 139062 - DNA, 582 bp, Homo sapiens
  Payload ID: 7252
  Gene Symbol: GTPBP1
  Gene Name: GTP binding protein 1
  ENST ID: ENST00000484971
  CDS Start-End: 1-92
ctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaagccatgatgaggagcagccctgggccaggtgccacggtcagtatgagaggctccaggatcaggctagagaaccacgcgaaccagtcacaggtccaaggggcaaatagcgaattcccatggaggagaatcactgcactccaagtggacgtggctggtaggatgggaagcagacgccacgggcacagagggaaggaagaagggagctgctggagcctgctaaccgcctcgagccacctgctgctcaggagaccctgcccgtccttttcatctgcatggggccacaggctcctctcttgtgctcctagaagtcagag

SEQ ID NO: 139063 - DNA, 505 bp, Homo sapiens
  Payload ID: 7252
  Gene Symbol: GTPBP1
  Gene Name: GTP binding protein 1
  ENST ID: ENST00000470836
  CDS Start-End: 389-505
gattcggagaccgagagtctcctctccctggaccgcgcgggacagcagaggggcgagggggcccgggcagggggccgagacgctcatgaagacaggtagtcggaggccagggcagggtggccgccgcgtctcttcccagactcgggaaaggaaacagaaagtagtcgctcagctggggaggagcatgtccgagaatgtctacttttcgaggccacccgaaacaaaatggaaagatggtcaggctccttagtctcgctatcctgtgagtggaagctcatcttgtatgagtggagcagtgaaggacgtttaaaaccgtgttttttgagctgtcgagaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtg

SEQ ID NO: 139064 - DNA, 585 bp, Homo sapiens
  Payload ID: 7252
  Gene Symbol: GTPBP1
  Gene Name: GTP binding protein 1
  ENST ID: ENST00000484657
  CDS Start-End: 128-585
aattattcattaggtacttgaaagctctgcagggattggtggctgagaggcctagtcgactgtttcttagctagagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcag

SEQ ID NO: 139065 - DNA, 358 bp, Homo sapiens
  Payload ID: 7252
  Gene Symbol: GTPBP1
  Gene Name: GTP binding protein 1
  ENST ID: ENST00000487538
  CDS Start-End: 1-273
tcacaggtccaaggggcaaatagcgaattcccatggaggagaatcactgcactccaagtggacgtggctggtagggtaacttctgccagcctcttcccccagcccccaccaactgccccacagagaacaaaccagaagggcgactacctgaacaagagctgcaagagcccaagggggcagcctgagcggacgacccctacatcagggcctggatgggaagcagacgccacgggcacagagggaaggaagaagggagctgctggagcctgctaaccgcctcgagccacctgctgctcaggagaccctgcccgtccttttcatctgcatggggccacaggctcctctcttgtgctcctag

SEQ ID NO: 139066 - DNA, 2933 bp, Homo sapiens
  Payload ID: 7253
  Gene Symbol: GTPBP2
  Gene Name: GTP binding protein 2
  Uniprot ID: Q9BX10
  ENST ID: ENST00000307126
  CDS Start-End: 1-1809
atggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 139067 - DNA, 2830 bp, Homo sapiens
  Payload ID: 7253
  Gene Symbol: GTPBP2
  Gene Name: GTP binding protein 2
  Uniprot ID: Q9BX10
  ENST ID: ENST00000307114
  CDS Start-End: 154-1698
gtttcctagaccagtgacaaagaaaggttttaacagcctgggcacagaggagacatagacttctgggaaaagcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgctt

SEQ ID NO: 139068 - DNA, 1394 bp, Homo sapiens
  Payload ID: 7253
  Gene Symbol: GTPBP2
  Gene Name: GTP binding protein 2
  ENST ID: ENST00000419497
  CDS Start-End: 1-460
tgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 139069 - DNA, 1850 bp, Homo sapiens
  Payload ID: 7253
  Gene Symbol: GTPBP2
  Gene Name: GTP binding protein 2
  ENST ID: ENST00000432918
  CDS Start-End: 1-463
tgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggtgagagggacctggccttccatttctccagaggtcagaaaagagggaggcctgccccagactggcagagaactccttgatcccacaatgggaataaaaccccacttagggtgggtagcggcctgataggcctctggagggtggagagccacggctggcagagaatgggacagaaggcactggccaggggagtgaccacttatttgctgcaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 139070 - DNA, 681 bp, Homo sapiens
  Payload ID: 7253
  Gene Symbol: GTPBP2
  Gene Name: GTP binding protein 2
  ENST ID: ENST00000452781
  CDS Start-End: 1-681
atggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaataccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagag

SEQ ID NO: 139071 - DNA, 946 bp, Homo sapiens
  Payload ID: 7253
  Gene Symbol: GTPBP2
  Gene Name: GTP binding protein 2
  ENST ID: ENST00000442748
  CDS Start-End: 1-946
cccagggaggaggggcacgggaggagaacacctctttcaggtcccgggaccccagggaggaagggcagagactggactctcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcac

SEQ ID NO: 139072 - DNA, 516 bp, Homo sapiens
  Payload ID: 7253
  Gene Symbol: GTPBP2
  Gene Name: GTP binding protein 2
  ENST ID: ENST00000496137
  CDS Start-End: 1-318
ggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaaagagcagctgatatgtaaattgcaaagcccaccccaggaataaagaaagaaaatcttacatca

SEQ ID NO: 139073 - DNA, 2579 bp, Homo sapiens
  Payload ID: 7254
  Gene Symbol: GTPBP3
  Gene Name: GTP binding protein 3 (mitochondrial)
  Uniprot ID: Q969Y2
  ENST ID: ENST00000324894
  CDS Start-End: 69-1547
cggggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttcattgctctacaaa

SEQ ID NO: 139074 - DNA, 1951 bp, Homo sapiens
  Payload ID: 7254
  Gene Symbol: GTPBP3
  Gene Name: GTP binding protein 3 (mitochondrial)
  Uniprot ID: Q969Y2
  ENST ID: ENST00000358792
  CDS Start-End: 58-1632
gcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaaggtgggtctacctggtggtgggggaggaagacacctcatatcagccctcaaaggctcccctcactgtctctctctgcctgccttctctcacccacagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaa

SEQ ID NO: 139075 - DNA, 1894 bp, Homo sapiens
  Payload ID: 7254
  Gene Symbol: GTPBP3
  Gene Name: GTP binding protein 3 (mitochondrial)
  Uniprot ID: Q969Y2
  ENST ID: ENST00000361619
  CDS Start-End: 85-1629
gttcgcgtctccgcccgtgttgttttctgggtttccttctcgcccgcctacctcgctccctgctgctggtccccgcccgcactgatggtgcattctccaacttgtccccacccatgctttcttctggtccccgcctcggagcctcagtttccccatctgcaaactccggaccctggagacgctgtttggaatgtgagatgggcattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtata

SEQ ID NO: 139076 - DNA, 1105 bp, Homo sapiens
  Payload ID: 7254
  Gene Symbol: GTPBP3
  Gene Name: GTP binding protein 3 (mitochondrial)
  ENST ID: ENST00000600610
  CDS Start-End: 25-159
aggcgggtcgcaggttgtaaatccatgtggcgggggctttggaccctggcggcccaagcggcacgtgggcctcgcagaacatccaatttgtgcatcccccagccgcagaacccccccacctggagcatctcgcgatcatcgagccctcggtctacttgacactgaggctgagcctcccaggtgcgctgattcgcctcccctccggttccagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagca

SEQ ID NO: 139077 - DNA, 617 bp, Homo sapiens
  Payload ID: 7254
  Gene Symbol: GTPBP3
  Gene Name: GTP binding protein 3 (mitochondrial)
  ENST ID: ENST00000602165
  CDS Start-End: 42-347
acacaggcaggtcgggcaggcgggtcgcaggttgtaaatccatgtggcgggggctttggaccctggcggcccaagcgattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagc

SEQ ID NO: 139078 - DNA, 934 bp, Homo sapiens
  Payload ID: 7254
  Gene Symbol: GTPBP3
  Gene Name: GTP binding protein 3 (mitochondrial)
  ENST ID: ENST00000594018
  CDS Start-End: 21-704
gggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaaccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggct

SEQ ID NO: 139079 - DNA, 584 bp, Homo sapiens
  Payload ID: 7254
  Gene Symbol: GTPBP3
  Gene Name: GTP binding protein 3 (mitochondrial)
  ENST ID: ENST00000601213
  CDS Start-End: 5-382
actgatggtgcattctccaacttgtccccacccatgctttcttctggtccccgcctcggagcctcagtttccccatctgcaaactccggaccctggagacgctgtttggaatattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcag

SEQ ID NO: 139080 - DNA, 808 bp, Homo sapiens
  Payload ID: 7254
  Gene Symbol: GTPBP3
  Gene Name: GTP binding protein 3 (mitochondrial)
  ENST ID: ENST00000598493
  CDS Start-End: 54-509
agacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccacc

SEQ ID NO: 139081 - DNA, 2493 bp, Homo sapiens
  Payload ID: 7254
  Gene Symbol: GTPBP3
  Gene Name: GTP binding protein 3 (mitochondrial)
  Uniprot ID: Q969Y2
  ENST ID: ENST00000600625
  CDS Start-End: 58-1473
gcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcacagcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcaccagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggtgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgttca

SEQ ID NO: 139082 - DNA, 756 bp, Homo sapiens
  Payload ID: 7255
  Gene Symbol: GTPBP4
  Gene Name: GTP binding protein 4
  ENST ID: ENST00000360059
  CDS Start-End: 337-756
gggtccaccagagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaag

SEQ ID NO: 139083 - DNA, 5075 bp, Homo sapiens
  Payload ID: 7255
  Gene Symbol: GTPBP4
  Gene Name: GTP binding protein 4
  Uniprot ID: Q9BZE4
  ENST ID: ENST00000360803
  CDS Start-End: 462-2366
tttgcggggctcgccgcgacccaggacccccagactcccggatcccctagaccctctggactcctaagccccgcaactcccaaatcccaagaccccggaccctccaaccctggcccagggcgcgtggctgggggcctgaacccgctccagaaacccgcagggcagtctgtcggaaacccccgctttactcagcaggaatttagtctccgcgctccccctaaaacccgggcgtcctctcctctgtaccctcgctcctgaggccctcacacgccctccgtggctgacctccaagccgggcgggtgcgctgtgcgacgcggaaagcgccgtagagcacgcagaacacgattggctgagctcccggaagtgacgtacctcaaccgcccgacagtggaagtcccacctgcgcccgacggcggaagttccgggagtgccaagtacccgcgtgcatacggctgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcctgtagttccagcactttgggaggccgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgggtgacagagagagactccgtgtgaaaaaaaaaaaaaaaataccaggtctggtttttgaaattctttctccgtattaaacaccaaaacttaacatatagtttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtagtcccaactacttgggaggctgaggcaggagaatggcttgaacccgggaggcggagcttgcagtgagccaagatcgcaccactgcactccagcctggtcgacagcgagactccatctcaaaaaaaaaaaaaaaataccaggtctggtttttgaaattctttctccgtattaaacaccaaaacttaacatatagtttactttgtgttaaacaacaacagtatgttttaaagcaagtatgtctttatttgtaagcatattactgaaacgatcaaatgaacagaagtggataaacgtcgagtcacttggctgagaccatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtccgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgcttttcgtttcactgggatccgggttcagagtgacgtttttcctcacaagcagaaggtaacaaatttcatgctctccccaaattctgtctgattttgccttgtggtgatagattgtcatgaacacaatgtcctctggagaaatctattgacagaaattggtgcagtgttaacaacgctaatgtaaaacacagaatttacagaaaaatagagaaaataaacacatttgttttcctcagaaaatgaa

SEQ ID NO: 139084 - DNA, 1907 bp, Homo sapiens
  Payload ID: 7256
  Gene Symbol: GTPBP6
  Gene Name: GTP binding protein 6 (putative)
  ENST ID: ENST00000326153
  CDS Start-End: 33-1583
ccccgccccaacgttcagcctccagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacatcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtga

SEQ ID NO: 139085 - DNA, 2208 bp, Homo sapiens
  Payload ID: 7257
  Gene Symbol: GEM
  Gene Name: GTP binding protein overexpressed in skeletal muscle
  Uniprot ID: P55040
  ENST ID: ENST00000297596
  CDS Start-End: 266-1156
ataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaaaagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccaagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttga

SEQ ID NO: 139086 - DNA, 2103 bp, Homo sapiens
  Payload ID: 7257
  Gene Symbol: GEM
  Gene Name: GTP binding protein overexpressed in skeletal muscle
  Uniprot ID: P55040
  ENST ID: ENST00000396194
  CDS Start-End: 156-1046
tggttataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccaagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaa

SEQ ID NO: 139087 - DNA, 363 bp, Homo sapiens
  Payload ID: 7257
  Gene Symbol: GEM
  Gene Name: GTP binding protein overexpressed in skeletal muscle
  ENST ID: ENST00000523433
  CDS Start-End: 83-363
gttaaccgtatttgttttcccatgcaaatgatagtctgcctgaggagctggttactgacagtgtgggcagcatgactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacat

SEQ ID NO: 139088 - DNA, 1977 bp, Homo sapiens
  Payload ID: 7258
  Gene Symbol: GCH1
  Gene Name: GTP cyclohydrolase 1
  Uniprot ID: P30793
  ENST ID: ENST00000395514
  CDS Start-End: 162-914
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttgttcttgtg

SEQ ID NO: 139089 - DNA, 2943 bp, Homo sapiens
  Payload ID: 7258
  Gene Symbol: GCH1
  Gene Name: GTP cyclohydrolase 1
  Uniprot ID: P30793
  ENST ID: ENST00000491895
  CDS Start-End: 190-942
aaaaaggaggcgcggccgggctttccagcctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttg

SEQ ID NO: 139090 - DNA, 1897 bp, Homo sapiens
  Payload ID: 7258
  Gene Symbol: GCH1
  Gene Name: GTP cyclohydrolase 1
  Uniprot ID: P30793
  ENST ID: ENST00000543643
  CDS Start-End: 145-846
ctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgaagtcaaataaatataataaagggttgagccctctactttcttcttgccacctttttgtggcaatattaaagtgaactgctaatagtgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttg

SEQ ID NO: 139091 - DNA, 1805 bp, Homo sapiens
  Payload ID: 7258
  Gene Symbol: GCH1
  Gene Name: GTP cyclohydrolase 1
  Uniprot ID: P30793
  ENST ID: ENST00000536224
  CDS Start-End: 154-795
cgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaac

SEQ ID NO: 139092 - DNA, 2923 bp, Homo sapiens
  Payload ID: 7258
  Gene Symbol: GCH1
  Gene Name: GTP cyclohydrolase 1
  Uniprot ID: P30793
  ENST ID: ENST00000622544
  CDS Start-End: 162-914
cctgtggccgctcccggctcggagtgtgatctaagcaggttgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaaggtggtcctatttaaattattaaactattgtaactttgttcttgtg

SEQ ID NO: 139093 - DNA, 777 bp, Homo sapiens
  Payload ID: 7259
  Gene Symbol: GCHFR
  Gene Name: GTP cyclohydrolase I feedback regulator
  Uniprot ID: P30047
  ENST ID: ENST00000260447
  CDS Start-End: 162-416
cacggcggtcacgggcaaggtgccccgggattgacgccgcctgtggccagagccggagtaacgggactcccagctgcgcgtcgcagtcccgacgcgagaagggctggagtcggcgtccagcctagagcccccggtgggagccaggccgggacgcgtgcaccatgccctacctgctcatcagcacccagatccgcatggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtggc

SEQ ID NO: 139094 - DNA, 785 bp, Homo sapiens
  Payload ID: 7259
  Gene Symbol: GCHFR
  Gene Name: GTP cyclohydrolase I feedback regulator
  ENST ID: ENST00000558467
  CDS Start-End: 223-426
ctagggagggcgcctacattgctcctcctgatcattgatgggctccaccccttcacagcttgtgctcagcccctaagaatccttgctactctctgtagcctttacctgaaccttactcagggctagcaggcaggggaggaaggacaggcaagaccttccacctcctcctggcagccagccaagcagccactgtggcttaccttgcaggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtg

SEQ ID NO: 139095 - DNA, 626 bp, Homo sapiens
  Payload ID: 7259
  Gene Symbol: GCHFR
  Gene Name: GTP cyclohydrolase I feedback regulator
  Uniprot ID: P30047
  ENST ID: ENST00000559445
  CDS Start-End: 55-276
agtcggcgtccagcctagagcccccggtgggagccaggccgggacgcgtgcaccatgccctacctgctcatcagcacccagatccgcatgtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctg

SEQ ID NO: 139096 - DNA, 572 bp, Homo sapiens
  Payload ID: 7259
  Gene Symbol: GCHFR
  Gene Name: GTP cyclohydrolase I feedback regulator
  ENST ID: ENST00000561160
  CDS Start-End: 78-212
agtcccgacgcgagaagggctggagtcggcgtccagcctagagcccccggtgggagccaggccgggacgcgtgcaccatgccctacctgctcatcagcacccagatccgcatggaggtgggccccactatggtgggcgatgaacagtcggatccagagctgatgcagcatctgggggcttcaaagagaagagccttgggaaacaacttgtaagtagcagcctccctcagtatcctctccctgccagcccctagacctgcctctgctccctttatacaacctccaagcccagggacagggcccagcatcagagccccctgcctgcatcctggggctctgttctccggaggagttggtcccatctgtagcctctccaacatcccccctctcccccacgaggcttgctctgaaagctttccacatccttactggaaccgcagaaacagagtccgttccctgggtctaggactccactagcagactgttccttgccctgccctctcctaagctggaccccatcaaggacagacaggcacagagagaaaggtttttgtcgtgaggatctgcatgagt

SEQ ID NO: 139097 - DNA, 695 bp, Homo sapiens
  Payload ID: 7259
  Gene Symbol: GCHFR
  Gene Name: GTP cyclohydrolase I feedback regulator
  ENST ID: ENST00000559932
  CDS Start-End: 199-402
attgccgcgaaggggcccgggtacgtgcgtcccggcaacagggcgacctccgggcgcttccggctcctgtcctacctgtcggcgggagagacccagggagccctggcctcacgcgcagcacctagtgccctgcacagagccgctccgcaggggaaaaaagggcgaataacctgagagaaagaggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggca

SEQ ID NO: 139098 - DNA, 412 bp, Homo sapiens
  Payload ID: 7259
  Gene Symbol: GCHFR
  Gene Name: GTP cyclohydrolase I feedback regulator
  ENST ID: ENST00000558670
  CDS Start-End: 59-100
ctggagtcggcgtccagcctagagcccccggtgggagccaggccgggacgcgtgcaccatgccctacctgctcatcagcacccagatccgcatgttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccgg

SEQ ID NO: 139099 - DNA, 2803 bp, Homo sapiens
  Payload ID: 7260
  Gene Symbol: G3BP1
  Gene Name: GTPase activating protein (SH3 domain) binding protein 1
  Uniprot ID: Q13283
  ENST ID: ENST00000356245
  CDS Start-End: 144-1544
agcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaat

SEQ ID NO: 139100 - DNA, 10240 bp, Homo sapiens
  Payload ID: 7260
  Gene Symbol: G3BP1
  Gene Name: GTPase activating protein (SH3 domain) binding protein 1
  Uniprot ID: Q13283
  ENST ID: ENST00000394123
  CDS Start-End: 146-1546
agggtgagtggcagttatatagaccggcggcggagcacgcgtgtgtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgtagggttaaagtaactttggtaaccacttttggcccagatcactgataataggaagaaatacaacttatacttttgtagcttatattaagcatgtggtgggtggaaagaaaagtttagtctgagtcactttggaaaaaaaaattactttgtggtaacttcaaggtcataaattatggatagcctagaaattatccttcatgagtgaatactaaattatacatttcaaaacagaagttcttcctacttggagacttaagggcattaactagatgcagcaatcctcagcttggtgttatcacatactagaggacatttggaaatgtgtgaaatttggaagggttgttggagagacatgcatctggcatttattgggtggggtctaaggataccaaatgttgtgtaaaaatgaagcaaccccattgagaacactgatagtccctattcctgtgggtgggtggagctgtgggattaggaaaactggaatgaagactcattcttttgaaactcagcctcagataaataacaaactaggaaatggaaatctgtttcaagaattgcagtaacatctactctaaggaattagtaatttcactttttattatttgtaccaaatgtatgtgtgtgttgtgtatgttggtgtaaatgtggagaggtggtagcaatacatactgatgctgcttgtaatttgttgcagggaattactgcacaatctcagaaaatagaaagcttccccagtgctttctgtcatcagagttgggatgattgtgaggttttgaatgatagtattggacctaagaaataggattagcatcatgatcagaactgttgagaatccttgtacaattatgtacattattgcatgtagagtaaacctgagagcttagagatgtatacgtttccactgctggaaaatcattataagttagggcaacattttctataggtggcagcagtaggagctcatcacattgaacattttcagattttaaaatgaaaattttcatccgtaggaatggcccaatgtatagttattagctactgagcttagaactcttgacccatgagattttttttttaaatttttatttttatagaggcaaggtcttgctatgttgtcaggctggtctcaagctcctggcctcatcagttctcctgccttccaagtagccggaactacaggtgtgcaccattgcacctggcctcatgagtattttagttagataagatttgtttggttcagtgggtcttagttttttaagacctgttaatttgtaattagacatcttgggccttaaactgtatttttgttttagtggtgaggttgggttttactttgtgtattccagcgttctcaactttgtcagatattgctagggaccagtgagatagataatccaaaaataataatttgactttggttgagtatgtcattaccacagtgttagttgaattgcactttaggttagaaaagttaattttcacatctgtgctgcgggttaggtgatattgtcctcagcacaatagatgaggaagaaactgaatcagaacagttaaatgacaggcttccaagtcatccatgtagcaaggagcacatttgcctcccaaactgatgctttttctctagaaccataatgcccccctaattacatttcagtagcatagaccgcaatgaacttcctactgtagggagacttgagtctggaatacattcagaacaaggttaacattacagttcttaatttcctttagggcaaacaagataattaaacttgggttttgtgagtctttttttgatttgcagattatatatggtaacacaataatggtggtttgtttttaagttttttctcatcaggtttgataatttaatgcaaacttcaaatctggatgtgaataataatatttttattatagtataatccaggtgagtttatagaatttgtgttttgtgcttataaactgtcaccttctgatacttttcttcatccctctatttgaaaaacccttgtagaatttaacgatttaatggaaaatgttgcactttatagaaggccattttagaacttacaggtaacctttttgaagagcttagatttgtagaccactgtttatgctgagtgacatttcttttaaatggttgcatttgtcaaatctataaagatgttttttatattgcagttttctttttgtgctacttaaaggaatctttgcaatgctgcatatagataattgttgacctttttagttcagcagtttttaaacttgaagtaacatcagcatttatttgaatatcaggttttagctaactgcctaatgtaccaaaaaaaaattagcaatgtcttatgtgggatgaggggttaagttaaagttgctgatcaagtaatggccgtgtggcacaagatgataactaagaatttctggttctaaggtagtaatgccttttgggatttatatttgtttaatgttgagattctggggaccataggtgggcctgtcaactcttaacagactatagtaaaggagagatggtggcacatgtgagataaaacttgtttatatttacattcttattagtggatagatatcacctcagtacaacactgaaattaaactgccttgttcatgctttcatgtctcaaatcaaggcctaaatgagtaaaaagatgattacagattacctaaaacccttaaccagttttggtttttgattatgcatatgtgttggcttgcaattaggtttttagtttctgtttatgtgacttgtttgaaaacattggattcgtcttctctccacagtttctacttgaacctagtagcttattttaattccctgtaagaggaaaataatatagggaatctgttcaactattcctttaataaatcatgtgacttggccaattacagaaattcctaagtgtagtattttgaaatgtggccagtgtcccagatttgtaaggtacagtgtgcatacagtgtgtcttaggatttttttaagtaaattaaggatgtttaccagaaattattgatttactgaaccaagtatttattttcagaagcccacttttggggaaggttgcctatatttttgatagtaattagatggaagattaaatcctgtttaacctggatagaaacagttttaactattgctgaagttaaaatcactttggggtggggtggggtggctcatgcctgtaatcccagtgctgtgggaggctgaggccagaggattgctcgaggccaggaatttgagaccagcttgggcaacatagcaagaccctgtctctacagataattgaaaagtgagccagatgtggtggcgcattcctatagtctccgtctctcaggaggctgaggcaggagattgcttgagcccaggagttggaggctgcagtgagttatgatcataccactgcactctaacctgggtgacagagtgagaccctgtctctaaaaaacaaaaaattagaaaacaacaaaaaccacttcggttactcactgtcctcatgctttgatgtcagttgttctcctaaattttaaaattttgttatgaagattggatgtacactgatttggccctttaaatgacattataccaagaagttggtataagggagtaggagatgagaaaactttttgaaaaatcatttggtgcatgctaaggtagcttgtaggacatgtggttttaaaaaattcatggattttgaagaaggatagggtggaagtaaaatttagctgatagcatagggatcatttgtgatttatatagaaaataattatatttttgagtgagaagcatcagacttaaatttttttcttctattttggttattaccaaaaggaacagagaaactctcagaattctttgaatcatagaatgttagtgctggaaaggactaggaagtgacttgtacaaccccttcattttacaaaggatcagagagaattggttagtagagtcccaaatctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactggccagtttgaggtgcttccattggtctgggtaactagccatttcttcctgattgtgcctagtatatcccagacagtttgtttctatgcagaagaattttatatgaaattttcatttctttgcaaaaacttgttccttctttcagttcatgacatcatccatgctaaagtctgagtcatctgcttccatttttgttattccccacatccagtcttcagctaagtcctgtcagttctacctcaagtctttcccgtctttcttcctcacctatgtaatttcagtagtctctcagcttcacttaacctcttactccagcctactttatacacaatgttagattcatcttactgaaacatagttctgaccatgtattccatgtatgtgttctctctcccctattagactgtaagctccttatgggcaggatctgtgtctgagtcatctttgtatcttgcctagcacctatcaataaatacttcttgaatgaacaaatgaattctcatttctcgacataaagccttgtctaaagtgagatgttttccaggtcatacataggtttctccctggggtaattggaagttcttgcatataaagttggttaaatagtaataattatgagttaaccacagaaaatttcagaaaactttaatttttttccattggaatcagcatggatatgtgtatatggatggttcaataaatatacttttatatacatgtttcacagaaattttacattccatcttcaaactgcagaaatagattttttttttttacaagccaaaaaataactgccataacttttgtgacttcatgcaaaaaaaggggggaagagtaaggggcaaaagggaattagttgttcaaggttgagtgtccagtaagaagtaaaaatgttacattaaggaagcgattgcttaacacgctgcttaaggtggtagccagacaaatccttaactgcagcattaaggccataccaagtttatacatatatacaaagaaatttccatataaaagacatactatcacattttcttcttcataaggatgaggaactttgtaattctgacctgattttccaggccaattaattaaaatgtccccaggctgctttttagaagtatcttctactttggctagctgtcagagttgccgctatgtgagcttgtgacttctggtctggcgtgaaagtatgaatcatcttgaacctcttccatcatagcactatgttgctgagctaattcatgctgcccagctaagcacattttctacatccccaaagtatttggaatcacagcattgtaacttgtgattgtcttacctgtaacagactccacagtcatgctggcattgtgacctgaagaattacacagtgcccttcttagattctttggggttaaggtaacttcttgaataatgtactaatgaacgatagtgtttcaggaaacatgccctagctattggaagttcgtatctaacttttaccccttgtgtgtcatgatacatttaagttggtagctacatttttggaataaaggaaatgtaaaattatttgcagaataataacctgggatttgctcttctgcctaaacatcgaactagggaactttaaagacaaagggtgcatcttttgtgcaagtatctaagcgggcaaaatggggaaaacatgaagggcaagtcctttggggatgacttctaattaatgcagaagtcatttgctttggccaggttgggtgggactctgagattgcacactcttgccctgttggcagaaactagcccatcttaagttagtcaatgaatcctgagtcaaaatgaaaggttgctaaatctaagatcgagtgtataaataaaataaccccttcctccagtgactgtgcatttattttgtaataaactcattttggaatgttttagcaatgaa

SEQ ID NO: 139101 - DNA, 2700 bp, Homo sapiens
  Payload ID: 7260
  Gene Symbol: G3BP1
  Gene Name: GTPase activating protein (SH3 domain) binding protein 1
  Uniprot ID: Q13283
  ENST ID: ENST00000520177
  CDS Start-End: 133-501
gtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgagagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaa

SEQ ID NO: 139102 - DNA, 754 bp, Homo sapiens
  Payload ID: 7260
  Gene Symbol: G3BP1
  Gene Name: GTPase activating protein (SH3 domain) binding protein 1
  ENST ID: ENST00000520006
  CDS Start-End: 440-754
aacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttg

SEQ ID NO: 139103 - DNA, 580 bp, Homo sapiens
  Payload ID: 7260
  Gene Symbol: G3BP1
  Gene Name: GTPase activating protein (SH3 domain) binding protein 1
  Uniprot ID: Q13283
  ENST ID: ENST00000522367
  CDS Start-End: 133-501
gtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgagagtctgaagaagaagtagaggaacctgaagaaagacagcaaacacctgaggtggtacctgatgattctggaactttctatgatcaggcagttgtcag

SEQ ID NO: 139104 - DNA, 577 bp, Homo sapiens
  Payload ID: 7260
  Gene Symbol: G3BP1
  Gene Name: GTPase activating protein (SH3 domain) binding protein 1
  ENST ID: ENST00000507878
  CDS Start-End: 133-577
gtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagcttgcatattggataccacatgattatcagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttg

SEQ ID NO: 139105 - DNA, 783 bp, Homo sapiens
  Payload ID: 7260
  Gene Symbol: G3BP1
  Gene Name: GTPase activating protein (SH3 domain) binding protein 1
  ENST ID: ENST00000522666
  CDS Start-End: 184-297
gcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggttgaattgaccaaagcaatggtgatggagaagcctagtcccctgctggtcgggcgggaatttgtgagacagtattacacactgctgaaccaggccccagacatgctgcataggaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctc

SEQ ID NO: 139106 - DNA, 530 bp, Homo sapiens
  Payload ID: 7260
  Gene Symbol: G3BP1
  Gene Name: GTPase activating protein (SH3 domain) binding protein 1
  ENST ID: ENST00000520578
  CDS Start-End: 179-530
gcgcccgccaagaagcgcctggcggaagggcgcactctcaggccttccaccggcgaccttccggcgggagcctgcgggcggcgcaggaacgaccctccttcctctgccccgcagcagtgctgagtaatggtgagagcagcaaggcccttggccgccgcacgttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgagg

SEQ ID NO: 139107 - DNA, 558 bp, Homo sapiens
  Payload ID: 7260
  Gene Symbol: G3BP1
  Gene Name: GTPase activating protein (SH3 domain) binding protein 1
  ENST ID: ENST00000517947
  CDS Start-End: 102-215
gtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgggcgggaatttgtgagacagtattacacactgctgaaccaggccccagacatgctgcataggaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcag

SEQ ID NO: 139108 - DNA, 1763 bp, Homo sapiens
  Payload ID: 7260
  Gene Symbol: G3BP1
  Gene Name: GTPase activating protein (SH3 domain) binding protein 1
  ENST ID: ENST00000522761
  CDS Start-End: 163-624
ttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggttcatcttgcactgttcctggcccagtccctattcttgaatcagctgttccttcaaggaggcctggttctttttagttatacttatgaaaggacgacaagtttatgttgaatgattgcatttgtgttttcttccggattggtctagactgaacaagagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttt

SEQ ID NO: 139109 - DNA, 535 bp, Homo sapiens
  Payload ID: 7260
  Gene Symbol: G3BP1
  Gene Name: GTPase activating protein (SH3 domain) binding protein 1
  ENST ID: ENST00000523519
  CDS Start-End: 218-535
acaaagggagcctcgccacacgcccgcggccgcctcgcagcgcccgccaagaagcgcctggcggaagggcgcactctcaggccttccaccggcgaccttccggcgggagcctgcgggcggcgcaggaacgaccctccttcctctgccccgcagcagtgctgagtaatggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgagg

SEQ ID NO: 139110 - DNA, 114 bp, Homo sapiens
  Payload ID: 7260
  Gene Symbol: G3BP1
  Gene Name: GTPase activating protein (SH3 domain) binding protein 1
  ENST ID: ENST00000627077
  CDS Start-End: 1-114
atggtgatggagaagcctagtcccctgctggtcgggcgggaatttgtgagacagtattacacactgctgaaccaggccccagacatgctgcataggaaatccacaggaaagtga

SEQ ID NO: 139111 - DNA, 2609 bp, Homo sapiens
  Payload ID: 7261
  Gene Symbol: G3BP2
  Gene Name: GTPase activating protein (SH3 domain) binding protein 2
  Uniprot ID: Q9UN86
  ENST ID: ENST00000357854
  CDS Start-End: 219-1568
ccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaa

SEQ ID NO: 139112 - DNA, 4883 bp, Homo sapiens
  Payload ID: 7261
  Gene Symbol: G3BP2
  Gene Name: GTPase activating protein (SH3 domain) binding protein 2
  Uniprot ID: Q9UN86
  ENST ID: ENST00000359707
  CDS Start-End: 787-2235
taaagcccacgtcatgttcttcctttactgcagggcctcttaatggggcttaaaacctaggatgggttaagtaaacaatgtaggtgagtttagtgtgcaaacagctgaaatcaccggctgcattttaagctcgtctacagcagcaacctgcagacacctattcagagagattactaaattccctccttcccattaataaaaaggaccagaatatcagtctacaaaagacactgcgttgctgcgaaccagctctcgcttgcgcgatcaggaagaagggcggcaaggctggagcctcgggaccggagaaaggcagcctgcttgtgacgtcaaatcagcggactcttatcttggctttaggccggttccggttccccggctttccgggcgcgagcgtgtgcgagcgcggcagcgtactgcgcgtgctccgcagagggacacgggaaggttgggtccggctctggaggagatgcgtgattggctgacgctgtgctcgggggttccctggccctttcggcaggggtaaaacaataagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 139113 - DNA, 4217 bp, Homo sapiens
  Payload ID: 7261
  Gene Symbol: G3BP2
  Gene Name: GTPase activating protein (SH3 domain) binding protein 2
  Uniprot ID: Q9UN86
  ENST ID: ENST00000395719
  CDS Start-End: 121-1569
gagcccgggagccggaggtgtagcggcagagacattgttcttgccggctccctacggtgccgtgtgtgcgtgagagaagaccagtctttcctctagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 139114 - DNA, 573 bp, Homo sapiens
  Payload ID: 7261
  Gene Symbol: G3BP2
  Gene Name: GTPase activating protein (SH3 domain) binding protein 2
  ENST ID: ENST00000511868
  CDS Start-End: 275-573
ctgcgcagaccccgcctcccaccgcaggggcacgcctcctacccccacccttcgcggattgatcctgctggccgcagccacccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaa

SEQ ID NO: 139115 - DNA, 567 bp, Homo sapiens
  Payload ID: 7261
  Gene Symbol: G3BP2
  Gene Name: GTPase activating protein (SH3 domain) binding protein 2
  ENST ID: ENST00000507252
  CDS Start-End: 261-567
gacgcagatgcgaaagtggcggcctccgggcaccatttctgtgcacggaaacagaatccgggtttgaaggcagccgccgcttcgcttacccagttaggccgggcacggtggctcacgcctgtaatcccagcactttgggaggccgaggcgggcggatcatctgaggtcaggagttcgaggccagcctgaccaacatggagaaaccccgtctctactaaaaatacataattagccagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggac

SEQ ID NO: 139116 - DNA, 584 bp, Homo sapiens
  Payload ID: 7261
  Gene Symbol: G3BP2
  Gene Name: GTPase activating protein (SH3 domain) binding protein 2
  ENST ID: ENST00000507745
  CDS Start-End: 160-584
gacgcagatgcgaaagtggcggcctccgggcaccatttctgtgcacggaaacagaatccgggtttgaagatcttctttgtgaagctttcattcaatggtgtaccacaaaagattgaaggtcatttctttaaaaagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctga

SEQ ID NO: 139117 - DNA, 508 bp, Homo sapiens
  Payload ID: 7261
  Gene Symbol: G3BP2
  Gene Name: GTPase activating protein (SH3 domain) binding protein 2
  ENST ID: ENST00000499709
  CDS Start-End: 341-508
ggattgatcctgctggccgcagccacccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagggctttgtttggtggtaaaaagggttactagacacccctcattccactgccactggagggcgcatttctcagctcttgctcttcaaacctgctgaaaggaattcctagatctaaacaccagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttat

SEQ ID NO: 139118 - DNA, 554 bp, Homo sapiens
  Payload ID: 7261
  Gene Symbol: G3BP2
  Gene Name: GTPase activating protein (SH3 domain) binding protein 2
  ENST ID: ENST00000508510
  CDS Start-End: 378-554
gtgtttaatcgtcgccaagcgggacttactgcaagctatcaaatctgaggtcttattttgttgagtcgaaagtgaaattttcctttggccaacgtgacagggctttgtttggtggtaaaaagggttactagacacccctcattccactgccactggagggcgcatttctcagctcttgctcttcaaacctgctgaaaggaattcctagatctaaacaccagtttccttcatgtccttatcgcttcctgtccaaatctactgaaaaccccttcggctgttacttctggatgtgatgtcgcagtctttagcccatcctgtctgctagtgccatctgaaatccttcctggaacttgcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaat

SEQ ID NO: 139119 - DNA, 577 bp, Homo sapiens
  Payload ID: 7261
  Gene Symbol: G3BP2
  Gene Name: GTPase activating protein (SH3 domain) binding protein 2
  ENST ID: ENST00000511146
  CDS Start-End: 231-577
aaaagaggttgtgtcgacggaggcagaagcgacgcagatgcgaaagtggcggcctccgggcaccatttctgtgcacggaaacagaatccgggtttgaaggcagccgccgcttcgcttacccagtacctagtgttccgtcgtgtttgaccaacccccctctccctgccaccgcgggtttaatccgaacgtgttcggatactggaactcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcc

SEQ ID NO: 139120 - DNA, 559 bp, Homo sapiens
  Payload ID: 7261
  Gene Symbol: G3BP2
  Gene Name: GTPase activating protein (SH3 domain) binding protein 2
  ENST ID: ENST00000509561
  CDS Start-End: 327-559
cccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagtttccttcatgtccttatcgcttcctgtccaaatctactgaaaaccccttcggctgttacttctggatgtgatgtcgcagtctttagcccatcctgtctgctagtgccatctgaaatccttcctggaacttgcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcg

SEQ ID NO: 139121 - DNA, 1071 bp, Homo sapiens
  Payload ID: 7261
  Gene Symbol: G3BP2
  Gene Name: GTPase activating protein (SH3 domain) binding protein 2
  ENST ID: ENST00000503660
  CDS Start-End: 477-1071
attccattcgcgctccgcggcgcgaggcaatcgtccggtgtgtgagcccgggagccggaggtgtagcggcagagacattgttcttgccggctccctacggtgccgtgtgtgcgtgagagaagaccagtctttcctctaggttaggccgggcacggtggctcacgcctgtaatcccagcactttgggaggccgaggcgggcggatcatctgaggtcaggagttcgaggccagcctgaccaacatggagaaaccccgtctctactaaaaatacataattagccaggtgtggtggcgtatgcctgtaatcccagctactcgggaggctgaggcaggagaatcgcttgaacccgggaggcggaggttgcagtgagctgagattgcgccattgcactccagcctgggcaaggagagtgaaactccgtctcaaaaaaaaaaaaaaaaaattatttcagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctg

SEQ ID NO: 139122 - DNA, 560 bp, Homo sapiens
  Payload ID: 7261
  Gene Symbol: G3BP2
  Gene Name: GTPase activating protein (SH3 domain) binding protein 2
  ENST ID: ENST00000515457
  CDS Start-End: 229-560
gcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagttattcttgtgtttgctccctcagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaac

SEQ ID NO: 139123 - DNA, 514 bp, Homo sapiens
  Payload ID: 7261
  Gene Symbol: G3BP2
  Gene Name: GTPase activating protein (SH3 domain) binding protein 2
  ENST ID: ENST00000509100
  CDS Start-End: 140-514
ttggggatgaggtggcgaagtggggggggaggcacgcagcagctcccgaaggcgcgctgatggaagcttaatacaggaagtgtgggagcaggctttctggaggggatgttttaggcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttat

SEQ ID NO: 139124 - DNA, 338 bp, Homo sapiens
  Payload ID: 7261
  Gene Symbol: G3BP2
  Gene Name: GTPase activating protein (SH3 domain) binding protein 2
  ENST ID: ENST00000510902
  CDS Start-End: 1-72
catggtggagtagatgctagtggaaagccccaggaagctgtttatggccaaaataatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaag

SEQ ID NO: 139125 - DNA, 2667 bp, Homo sapiens
  Payload ID: 7262
  Gene Symbol: GAPVD1
  Gene Name: GTPase activating protein and VPS9 domains 1
  ENST ID: ENST00000265956
  CDS Start-End: 113-2002
ggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagcgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccattt

SEQ ID NO: 139126 - DNA, 6003 bp, Homo sapiens
  Payload ID: 7262
  Gene Symbol: GAPVD1
  Gene Name: GTPase activating protein and VPS9 domains 1
  Uniprot ID: Q14C86
  ENST ID: ENST00000297933
  CDS Start-End: 248-4630
gtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcat

SEQ ID NO: 139127 - DNA, 4320 bp, Homo sapiens
  Payload ID: 7262
  Gene Symbol: GAPVD1
  Gene Name: GTPase activating protein and VPS9 domains 1
  Uniprot ID: Q14C86
  ENST ID: ENST00000312123
  CDS Start-End: 1-4320
atggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtga

SEQ ID NO: 139128 - DNA, 4747 bp, Homo sapiens
  Payload ID: 7262
  Gene Symbol: GAPVD1
  Gene Name: GTPase activating protein and VPS9 domains 1
  ENST ID: ENST00000394083
  CDS Start-End: 150-4388
cgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaa

SEQ ID NO: 139129 - DNA, 3190 bp, Homo sapiens
  Payload ID: 7262
  Gene Symbol: GAPVD1
  Gene Name: GTPase activating protein and VPS9 domains 1
  ENST ID: ENST00000394084
  CDS Start-End: 330-1823
gggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctataggtaaagagaatttctcgtattggagctttctcttaaatctaatatttcattagcctttgttattgctgagtgttttggaacatatgtttaagtacttgggaaagtctttctcttcatgtttactgatggtatttcagtttttagaaatcgtatcagattagttaaggtttatcagtagtctttagctttgcctacatacttttcataattaattgaagtcatgctatccacagtatactttctttaaattttattgtcttttcttgaaaaaattttggaaatgttataagtagtcatctttaaaactatgtagccctcagcctggtgtggtggcacgtgcctgtggtccctgctacttgggaggctgagatggggagattgcttgagcctgggaggtcgaggctgcagtgaaccatgattgtgccactgcacttcagcctgggtgaccctgagtgagaccctatctcaaaaaaaaaaaaaattatgtagccccctcctttctacaaagttctaaataatataataaacaatattattttagaagtttccatcaataaagtggaaaataatagtattttctattattttcattaacaatcagtcttttatcaactgagctaagatatcttaatattacaaaatgaagcaaaagtttcattttattttttcaagtttgtttatttaagaattctatttaattaagccttatttgcttggttaacatttgctatctatctgtctataaaaaaattaattgagcatataccatgttccatactgtgggtaggcactttataaatgttgtttcatttaatccccacagaagtcctgtgagagtggatgtgtcttgcacatgaggcactgtgatagacactggatacaaagaccattaggacctgcccttactgtcaagttggctgttgatagtttagttagggagagcaagaagagactagtacccttcagcatactaagcgttctgaggagataaatatgagggttatggtgacacctaacttagccaaaatggtagtggtatcaggagaagatcttggagcaggtgaagtctgtttgcactttgtgatgaatgggagttagacaaagtaaacaagatgaggaaaaagtgtttaagccaggggaacaggagtattttagtgcctgcctatttataacgaggaactcagcaacacttagtgaacatagttctttttaatttatgcattttgaagagagggattttacttttaaacttctgtgagctaattttttaagaactgccagtttcttaaaattaatctaccttatatttaacgtaatgtggaattgtatcaacaggagtgtggcatcatactcttcaagtctttgtcttattgtatcaccccaaaatgtcagttttcaaaataaaaaatagaaaaagcga

SEQ ID NO: 139130 - DNA, 6737 bp, Homo sapiens
  Payload ID: 7262
  Gene Symbol: GAPVD1
  Gene Name: GTPase activating protein and VPS9 domains 1
  Uniprot ID: Q14C86
  ENST ID: ENST00000394104
  CDS Start-End: 37-4473
ttagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacaggtgataatcatgacagagatttgagtagtaaacttttatatcatagtgataaagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcgcgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgc

SEQ ID NO: 139131 - DNA, 5207 bp, Homo sapiens
  Payload ID: 7262
  Gene Symbol: GAPVD1
  Gene Name: GTPase activating protein and VPS9 domains 1
  Uniprot ID: Q14C86
  ENST ID: ENST00000394105
  CDS Start-End: 161-4624
aagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgata

SEQ ID NO: 139132 - DNA, 2490 bp, Homo sapiens
  Payload ID: 7262
  Gene Symbol: GAPVD1
  Gene Name: GTPase activating protein and VPS9 domains 1
  ENST ID: ENST00000436712
  CDS Start-End: 1-2490
tttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctataggacaacagttagcagccatcactgcctgggattcctcagctaccaatattacctctcatattacagtagtaaccccgtttgcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttag

SEQ ID NO: 139133 - DNA, 2512 bp, Homo sapiens
  Payload ID: 7262
  Gene Symbol: GAPVD1
  Gene Name: GTPase activating protein and VPS9 domains 1
  ENST ID: ENST00000431329
  CDS Start-End: 1-2512
gcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaa

SEQ ID NO: 139134 - DNA, 3163 bp, Homo sapiens
  Payload ID: 7262
  Gene Symbol: GAPVD1
  Gene Name: GTPase activating protein and VPS9 domains 1
  ENST ID: ENST00000467750
  CDS Start-End: 199-3163
gtggcggtccgacagagtcctccgtgtcctcccccgcatgacccccttgggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaag

SEQ ID NO: 139135 - DNA, 582 bp, Homo sapiens
  Payload ID: 7262
  Gene Symbol: GAPVD1
  Gene Name: GTPase activating protein and VPS9 domains 1
  ENST ID: ENST00000461379
  CDS Start-End: 232-582
agcgccgctgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctgga

SEQ ID NO: 139136 - DNA, 5309 bp, Homo sapiens
  Payload ID: 7262
  Gene Symbol: GAPVD1
  Gene Name: GTPase activating protein and VPS9 domains 1
  Uniprot ID: Q14C86
  ENST ID: ENST00000495955
  CDS Start-End: 291-4727
cggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacaggtgataatcatgacagagatttgagtagtaaacttttatatcatagtgataaagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgat

SEQ ID NO: 139137 - DNA, 8923 bp, Homo sapiens
  Payload ID: 7262
  Gene Symbol: GAPVD1
  Gene Name: GTPase activating protein and VPS9 domains 1
  Uniprot ID: Q14C86
  ENST ID: ENST00000470056
  CDS Start-End: 161-4462
aagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcgcgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcatcggggctcttttctgtggaagagaaggtggtgggattggggtgaagggctacactggaggcaggagatagggctgtgctgtgttggagccggggctgagggtagaccccccagagatttgacatctgtgacacctgtgaaatgggttcgggtgctcatgactccatagctggcggaggagcacagcacagctgttgcaggggcagctaaggtttcctctgaaaatctgtcaggagcaaggactactttggcattaaccatcactgtttgatttcttgacaggtatgtgagatggggagtgatttgatttttttttttttttttaatagaaaagaggaatagttgttccccaaatgtttcttcctccactgccttccagtactttctttacatgaaagattagtgtaaaagtacaaaatcagcccaggaaacattcagcagccactagttactacatagaatttataaagtggatgttaaatggagagagagttggctcaggtcccctgaaatcttgtaggattaacttctctgaggaaaagaaaaatcaggtttgcattttgtattaatattctgcttttagaagtaatagaaatacaagttgaagattgtctttacttacaaaattatattttaattttttttgagacatagtcttgctctgtcacccagtctggagtgcagtgctgtgatctcggctcactgtaaccaccatctcccagtctctagtgattctcatggctcagcctccctggttgctcagattacaagtgtatgccaccacacccagctaatttttgtattttttgtagagacagggtttcgccatgttggccaggctggtctcgaactcctggcctcaagtgatccgcctacctcggcttcccaaagtgctgggattataggcgtgagccaccgtgcccaaccacaaaattatatgtatatatatttaaacgtgtcaaacattttgctttctttctccattttaggtaaaatctcagccacagtaattgctttcttctgctttttctttataaaaacctgcttatgaaggccttctgatacagatagttaaatcgctgtagtaggaggctcaggttttctaagggattgcaaatgtgctgcatggtttttctattcctatgtcctggaagcctttgtttaaagtgggctttacaaatgtgtccctgaggtgcgtgagcaagagaacaatctcagccccaatacgggggctgtgttcttgccgtaagaatctgtagctgactggtgtgctgaacccgggcactctttttcctattgtttgccatggaaatttccactttggaccgagtaaggtcaactaggtgttttaaaattgtttttctcctatgtgattgggtgtgaagagggaaagtaggaatacactcagaattattactggattgcataaaagtgatagaagtgtagtggggttcacttcctcaattggtgcttcctagatttttctctcccatctcttcctgctttgtttctttaaagaaaaggctgttgtctctctttttaaatatttaagtctagtgagtttattttgtacgcaattgctttaattttaagggaagtaaatctgaaactatcttgaagcccaaaggatttttagtaagtggattaacagtgatgaggtatttgcgattactttaaatgccaaaatgcttgagaactttgccaggttaaaaattacttaatatattttagaatgtaggttagaaagtagtaggacaaggaatagctttattactcttgagaacacttggataaatgaaaatatagtttgcttccgtgttaagttgtggttgagctatggagtgaccctggagctgccgcatcccacaggcctgagctcagcaagggttcaattcaagagagatgacgtctccacttggataatggcagacagtgtgggtagcggccatgcactaggggaattcacctctgtcaaattaatactctcctgtctactggattcttcttgtgcttcacctggattaaaaagctgtactgcctcttttgaaacagataaaacctttctataagtctcaattaatgagcttgcacaatcttgtatatgtacaggaaacccctcctgtctcctaatgtgattagtactgtaaaatattctataaaactgattaaaaggggagagcagtttgattcacaggg

SEQ ID NO: 139138 - DNA, 3720 bp, Homo sapiens
  Payload ID: 7262
  Gene Symbol: GAPVD1
  Gene Name: GTPase activating protein and VPS9 domains 1
  ENST ID: ENST00000497580
  CDS Start-End: 199-2469
gcgctggcgtggcggcagcgccgctgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaaggtaattttataaaatattagaacgctgtattagcaataagaagcaaagccccagaatctctttcagagagccaatgtctcaactcctctgtaagacttgctgggcttaagtttctagctactttgagggtgtagaaagtggttccactcagatgaatgctaaggcagagctttagaaatgttcttgttctttgcaggaagtgatagtggtttcataaatggaagtcatgcctgtcactattgtttaaatatcatataccattgaagttaaacatatagaggacttctgacatatatattgctattaattattgcaggaaaatgggacgttattggtaattaaacattgaaaactcatcctttacattcctggaataagttgaagctttttatgtctatgttcattgagaatgtttatactgtaaatatcagtgagtgtttattttggaaggtagctgtataaaattgtttacttttttggtgaacagcctggcatcatttgagttggcaaaagcatctcttcctgaaagaagagagcatccaggagtaaagctagaaacttattccaaaggcctcttctcagcacggtggcactcaggaa

SEQ ID NO: 139139 - DNA, 3143 bp, Homo sapiens
  Payload ID: 7263
  Gene Symbol: GARNL3
  Gene Name: GTPase activating Rap/RanGAP domain-like 3
  ENST ID: ENST00000373386
  CDS Start-End: 10-2418
ataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccagggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattctta

SEQ ID NO: 139140 - DNA, 3800 bp, Homo sapiens
  Payload ID: 7263
  Gene Symbol: GARNL3
  Gene Name: GTPase activating Rap/RanGAP domain-like 3
  Uniprot ID: Q5VVW2
  ENST ID: ENST00000373387
  CDS Start-End: 353-3394
atatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatggtagttgatttttgcagaaggtttgtggccagatcgctatgtataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaacttta

SEQ ID NO: 139141 - DNA, 536 bp, Homo sapiens
  Payload ID: 7263
  Gene Symbol: GARNL3
  Gene Name: GTPase activating Rap/RanGAP domain-like 3
  ENST ID: ENST00000453030
  CDS Start-End: 95-241
aggaggtgctgaggcgaggagaggccgaactccaagggacgacgctcgcggaagcagaggtttggggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctgtaacttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacag

SEQ ID NO: 139142 - DNA, 3599 bp, Homo sapiens
  Payload ID: 7263
  Gene Symbol: GARNL3
  Gene Name: GTPase activating Rap/RanGAP domain-like 3
  Uniprot ID: Q5VVW2
  ENST ID: ENST00000435213
  CDS Start-End: 331-3306
actagaagcaagaatgtagcctgggtaatatctggaacactttcaaactgcatgcattgatgtgttgcccattttcagctaagagagggaggactacaaaaggttaaatttctcatataagattaattcagccatctctgtgaaatggtggaagcagaatgccattagactctctaatctcatttctctcatgctgtctttcttggagcctgtcaaacagtgtcctggcagagagtcagttctctggttgctaaacatcagagtcagtctctttctgcatgtgccaagagggctgtaatttagaaaatgcaacctaccttttaaggaaggatgaaaagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgc

SEQ ID NO: 139143 - DNA, 653 bp, Homo sapiens
  Payload ID: 7263
  Gene Symbol: GARNL3
  Gene Name: GTPase activating Rap/RanGAP domain-like 3
  ENST ID: ENST00000441134
  CDS Start-End: 78-224
agaagagggcggcgctgcggcgcagggggtgcagcttcgagagcccaaggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctgtaactctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaag

SEQ ID NO: 139144 - DNA, 694 bp, Homo sapiens
  Payload ID: 7263
  Gene Symbol: GARNL3
  Gene Name: GTPase activating Rap/RanGAP domain-like 3
  ENST ID: ENST00000429629
  CDS Start-End: 129-395
aggcggggctcctgggggcggagccatacctgtgggcgggacatgggaaaggagggcccgaggggcggagctacaatagaaagggccaggaggtgctgaggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaag

SEQ ID NO: 139145 - DNA, 905 bp, Homo sapiens
  Payload ID: 7263
  Gene Symbol: GARNL3
  Gene Name: GTPase activating Rap/RanGAP domain-like 3
  ENST ID: ENST00000439286
  CDS Start-End: 103-905
tacctcccccttgatgggtggcgggatcccggagccaacgcagaccggacgtcggaacgccgctttagccccgggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaaggg

SEQ ID NO: 139146 - DNA, 667 bp, Homo sapiens
  Payload ID: 7263
  Gene Symbol: GARNL3
  Gene Name: GTPase activating Rap/RanGAP domain-like 3
  ENST ID: ENST00000444677
  CDS Start-End: 250-667
agagcagaactgagcaggcggtggagctgggtctggtccgggcacggagtgggggcttcgaagggaaaaggcggggctcctgggggcggagccatacctgtgggcgggacatgggaaaggagggcccgaggggcggagctacaatagaaagggccaggaggtgctgaggcgaggagaggccgaactccaagggacgacgctcgcggaagcagaggtttggggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccg

SEQ ID NO: 139147 - DNA, 831 bp, Homo sapiens
  Payload ID: 7263
  Gene Symbol: GARNL3
  Gene Name: GTPase activating Rap/RanGAP domain-like 3
  ENST ID: ENST00000425970
  CDS Start-End: 331-831
actagaagcaagaatgtagcctgggtaatatctggaacactttcaaactgcatgcattgatgtgttgcccattttcagctaagagagggaggactacaaaaggttaaatttctcatataagattaattcagccatctctgtgaaatggtggaagcagaatgccattagactctctaatctcatttctctcatgctgtctttcttggagcctgtcaaacagtgtcctggcagagagtcagttctctggttgctaaacatcagagtcagtctctttctgcatgtgccaagagggctgtaatttagaaaatgcaacctaccttttaaggaaggatgaaaagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaag

SEQ ID NO: 139148 - DNA, 523 bp, Homo sapiens
  Payload ID: 7263
  Gene Symbol: GARNL3
  Gene Name: GTPase activating Rap/RanGAP domain-like 3
  ENST ID: ENST00000446764
  CDS Start-End: 194-523
gcgcgagccgagcggccggccgaggcccgagcccacccgagtgcgcccgagcccgcggcccccgcccggggcgatggaaccggagcccggcggggtggccgctgcgctcctgcggcagaagagggcggcgctgcggcgcagggggtgcagcttcgagagcccaaggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtg

SEQ ID NO: 139149 - DNA, 569 bp, Homo sapiens
  Payload ID: 7263
  Gene Symbol: GARNL3
  Gene Name: GTPase activating Rap/RanGAP domain-like 3
  ENST ID: ENST00000460176
  CDS Start-End: 1-245
tgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctg

SEQ ID NO: 139150 - DNA, 4420 bp, Homo sapiens
  Payload ID: 7264
  Gene Symbol: GIMAP1
  Gene Name: GTPase, IMAP family member 1
  Uniprot ID: Q8WWP7
  ENST ID: ENST00000307194
  CDS Start-End: 141-1061
agcttcctgatttctgaagtctgagtgatttcctccgtgtgccgagaggaaacagccttctgcactcacagccgaagggaaagcagcaggttggggcttcttgtggccaacttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcaggtgagggacatgttcggggaggacgtcctaaaatggatggtcatcgtcttcaccaggaaggaggacctggccgggggctccctgcacgattacgtgagcaacacagagaaccgggccttgcgcgagctggtggccgagtgcgggggccgggtctgtgcctttgataaccgggccaccggccgggagcaggaagcccaggtggagcagctgctggggatggtcgagggcttggtgctggagcacaagggcgcccattactccaacgaggtgtatgagctggcgcaggtgctgcgctgggcaggccctgaggagcggctccggcgggtggcggagcgcgtggcagccagggtgcagaggaggccatggggcgcctggctgtcggcccggctgtggaagtggctgaagtcccccaggagctggaggctgggcctggccctgctgctggggggcgcgctcctgttctgggtgctgctccacaggcggtggtcggaggccgttgcggaggtcgggcctgactgacagcgcaggtcctaaaactgaaggcaacttggttaagggaggctgaattcttggagctgaagggaaaacttcattccaacggaaggaatcctgtagtttcaggcatagttttaatgacacagaaaactttgctgcatcacctttgcaactttgccaaagctcagagttcactttttaagtttttaactcattttaaatgatgtgtatgcagagttttaaaataaattcgtctaacaataacttcctttggtagttttggtagtctaatgtcaagtagcttgtagtggggacaaacgcatggcacagggaaaacaagtgccattattttcgagctttttaaaaaatttagactgcccctccttgataattttctagttcttatacatgggtagataggttcctttgtgatccttgtagacttttagcatcaataaaagaaatgtgggggttacacacgtgaatgttacttctgagacatcagtttatagtacaatgatttactaccaaaaagatgaatgtaactgtactgttacaaagtggaaaataacagtttccacttttctagaacatattatggttcatggcattccaaaatgaagtaagggccgggcgaggtggctcacgcctgtaatcccaacactttgggaggtcgaggcaggtggatcacctgaggtcaggagttcgagaccagcctgaccaacatggcgaaaccccatctctactaaaaatacaaaaattagccaggcgtgatagcactcgcctgtaatcccagccattcaggaggctgaggcgggagaatcacttgatgcagtgagccgagatcgtgccactgcactccaggctgggtgacaaagcaagaatctgtctcaaaaaaaaaaaaagaaaagaaaagaaaaagaaaaagagtaggatattgggaaaataacatataatatcttctatatggttattcatatttttatcacacacacacacacacacacacacacacacagtctgtatctcgagctcctctctggttatggagaagaggcagagcaccaggtgcataggctgagactgcagacacctgagcatcctatgctgtgaggcgaaagcatccggttttttcgggatgggcctgtccaggaaggttctcgaatgccacgtgattagaaaatttgccgctgactggttgtgcgaatcaaacaataggatttccttatttctatttctgagcataatgagaaccctttaagggaactcattgtctttaaatcagccagcctctagtgaggtcatggagacatgggaagcaggtattcacattagctctattcaagaggaagaggaggagggagtgtgcgcaggcgccctagggtcttccccagcacacgttgggaagaaggggtctgcaagcatgcgcacaattgccagctcaggctaaggactgcaggaggttccaggtgggttgcgggcttcgggcaggctatggtgaggggtcctgagggccttggtgaccgctgcagggagttggactttttgaagcgtggctcaagaaaaacccatgtttaattcctgcctttcgcttcctcagcagcctttctgggcccaggcaggggcctcgagccagggaaggatcctttgatgaccagaggggacagcagggagggcacagcgtggtcgtccacggtcacttgcgcacgagccagtgctgctgctggtgttagacaacaacttttatcaaagtggtttaatgtacagcagcaacaaagctgctttgtggagcagggctcccaataggcagtgtgcccagagtagcagctcggaagcagtactgcaatcacatttatacccactttcaactatatgcaaatttaggggtggattatgccaaaatttctagaaaaaaggtcgtaacttccaggtcgtgggattgttgctatggaaaggagccaaaacttccagctgttgccttagcaatggtaacctgacgtggcactggtgagtgtgttttatggagagactctttcacctcttccctttcagcttgtcttcagtgtggtctggagcccaatccccacctccagagtctagtcctgcctcctacctcagtaataaaaagtagtagtatatggttaattgtcaaatacatttgcaaagtgtaatcaaagatacattaccaatctgaatctcaaaatgtgctatcatctttgaatttgaataatgtattattaaagaagttacagttttcctttacattcaataacatttctttagtggttttctttttcagatactttgattatgatcttttttttttcatctttgtatccccgttatacaacccagtgcctggcatagaaagtgggatcaacaaatgtttggaaaatgaattgtaaagttgactttcctgtacctttttaatattagatttctagctaccagacttttgaccattttctaaattttctaccatagataacagaaaattctttcgcgcaagcatgtcattgtattaatgatattctcctgccctaaggaaatttacttcccttcaagcacagggtcccccaaattactgtatttccacccctttcagcttattttatccttttctcctgctacagaacagttggcattcaccattcccttcggtaaagtctttttttaggctgtggcttaaaggttgctttttcccccatagctcaaggttaggccttgtgacctcacttatgtaatttgagtgatttgatagcacaaatcaattttatacttaaattacagcataaaacagcactgcctcctgttggaaaaacttgcttgctaattttaaccagacacagtaaaaatactgtccaatacctcaaaaattgtgtaaatatatatccatttcaattgtcccccttcctctcctctccttttatctcttggaagataaaaatgtatgggtcctgtgctgataatgtttctgttcatatttctatgccctggtacctggatcagcttttgttctacacaaaaagacttgtatctggcttatttctgaaagctagtgttggccatgatgaacttttagagcaaaagatttcaggcagagtacattcttacatattcttacacaatcaatattcagttccagcccgcacagtagccctagcaaatgccagtgctccttccagagattcacctatggattcagtaccccagaagagaatttctgtaaattcttggggaagctatagctagactatggctcaacactcatttttcccccatgattcttaatctaacagtggcaatgttggcctcttcttaggcaactagattcggttcttgcttattctgccaataaaatactttattgagatgcttacaaa

SEQ ID NO: 139151 - DNA, 1449 bp, Homo sapiens
  Payload ID: 7265
  Gene Symbol: GIMAP2
  Gene Name: GTPase, IMAP family member 2
  Uniprot ID: Q9UG22
  ENST ID: ENST00000223293
  CDS Start-End: 95-1108
gttttactttctttttctcttggagctgagctataagacaacaggactgaacagggagccaactgtttctttgaacagtaaatcaggaacaccaatggaccaaaatgaacacagtcactggggaccacatgcaaagggccaatgtgccagcagatctgagctgagaatcatcctggtgggcaaaacaggaactggcaaaagtgctgcagggaacagcatcctcaggaagcaagcatttgaatcgaagctgggttcccagaccttgactaagacttgcagcaaaagtcagggaagctggggaaatagagagattgtcattattgacacaccagatatgttttcttggaaggaccactgtgaagctctgtacaaagaggtgcagaggtgctacttgctgtctgcaccaggaccccatgtgctgctcctggtgactcagctgggccgctatacctcacaggaccagcaggctgcacagagggtgaaggagatctttggagaggatgccatgggacacacaattgtcctctttacccacaaggaagacctcaatggtggctccctgatggattacatgcacgactcagataacaaagccctaagcaagctggtggcagcatgtggtgggcgaatctgtgcctttaataaccgtgctgaagggagcaatcaggatgaccaagtgaaggaactaatggactgtattgaggatctgttgatggagaaaaatggtgatcactataccaatgggttgtacagcctaatacagaggtctaaatgtggacctgtgggatcagatgaaagagtaaaggaattcaaacagagccttataaagtacatggaaactcaaagaagttacacagccttggctgaagcaaactgcctaaaaggagccttaatcaaaacacaactgtgtgttttattttgtattcagttgtttctcagattgataattctgtggctttgcatactgcacagcatgtgcaatttgttttgttgcttactctttagtatgtgcaatttattctgcagtttgctgtttattatacccaaaaagttaatgatatttttgagaacagttattagactagaacgcaagactcctaggttatagttacagatcccagttattatttactcactatcatttagtgggtgaatcacagtaatttccctgtaaaatgtggtacctgaagtcatatttgagattctatgaaatgtttaaatctgaacatcactccaattattaatgaaccaaatcatacgataagttactgtttgcattgaaatataatatcaaagccttttgaaatctgtaaacataaaattcctctcattttcaaatatctaaagccagttttatgttcctaaaatctcattttcttctttctagtactactatttctactgaatataatgaaaatggcaataaaataatattacataaactgtaaa

SEQ ID NO: 139152 - DNA, 309 bp, Homo sapiens
  Payload ID: 7265
  Gene Symbol: GIMAP2
  Gene Name: GTPase, IMAP family member 2
  ENST ID: ENST00000474605
  CDS Start-End: 68-199
gagctataagacaacaggactgaacagggagccaactgtttctttgaacagtaaatcaggaacaccaatggaccaaaatgaacacagtcactggggcgagaggaaggttaaacgtgcaatttggctgcctctaagcaagctccagcgcggtgtatcaggagctgcttggctgctgttttcagaatatagaaatgtgtaatgtaatgcctgcttccttttaagtacaagtgtccattgcatgtctactgtgaggccataatttcactggcctacagaaaataagattaaatgtccataaattttggccaa

SEQ ID NO: 139153 - DNA, 2060 bp, Homo sapiens
  Payload ID: 7266
  Gene Symbol: GIMAP4
  Gene Name: GTPase, IMAP family member 4
  Uniprot ID: Q9NUV9
  ENST ID: ENST00000255945
  CDS Start-End: 176-1165
aaagttctattagagctgctggatgatcaggtgggcaggtcccttgcacaagtaaatctggacagctcctcccctcacttcctctcttctcctgtttctcaacatcctggcttagtattgtgtgcaaaatcagagaggggtgcaagatcctgatttttcaggagttcaagcgacaatggcagcccaatacggcagtatgagcttcaaccccagcacaccaggggccagttatgggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctttctatgttggcagataatctccccttgtagcttccactcacttattcttgcattcagagtcacaatgatcatcttacccatgtggtttttgagaaagaaagatcaattctttgtttgcagtaggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctcata

SEQ ID NO: 139154 - DNA, 552 bp, Homo sapiens
  Payload ID: 7266
  Gene Symbol: GIMAP4
  Gene Name: GTPase, IMAP family member 4
  ENST ID: ENST00000479232
  CDS Start-End: 100-552
aggtaagggaataggggtgtgtgtggtgggggtcgggacgaatgtgcgattttggtgaggagggacctgtatcttaaatcgtctggagttcaagcgacaatggcagcccaatacggcagtatgagcttcaaccccagcacaccaggggccagttatggtgagagggcattcagtgctccccagaccaggctgcagggagggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatc

SEQ ID NO: 139155 - DNA, 1569 bp, Homo sapiens
  Payload ID: 7266
  Gene Symbol: GIMAP4
  Gene Name: GTPase, IMAP family member 4
  ENST ID: ENST00000461940
  CDS Start-End: 84-1115
tgtttctcaacatcctggcttagtattgtgtgcaaaatcagagaggggtgcaagatcctgatttttcaggagttcaagcgacaatggcagcccaatacggcagtatgagcttcaaccccagcacaccaggggccagttatggtgagagggcattcagtgctccccagaccaggctgcagggagggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctttctatgttggcagataatctccccttgtagcttccactcacttattcttgcattcagagtcacaatgatcatcttacccatgtggtttttgagaaagaaagatcaattctttgtttgcagtaggtaat

SEQ ID NO: 139156 - DNA, 2291 bp, Homo sapiens
  Payload ID: 7267
  Gene Symbol: GIMAP5
  Gene Name: GTPase, IMAP family member 5
  Uniprot ID: Q96F15
  ENST ID: ENST00000358647
  CDS Start-End: 368-1291
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccacattcctttttatcctttaaatctgttggaacttcccagtccacatgcttcctttgagcaagtggcatctagaataaaggaacagggttggcttttcttgttcctaaaattaggaagaacctcctgctcctactgaagtgcctgccacatagtggacattccctgaactctgagtaaagcaaaacactttcagatggatggattgcattgacgaatgggagtgggagagggtcaaggaaatggggtgccctgtacgcagggctttctctgtgctttcttctcagtttggccaggggcccaaaagaaacacagctcacatttcaatgctctgcaaggaatcactttggcaaatgttcacacatgagaaaggttaagcaaactctttctccttctccactgtaaaatgtccttggatcaac

SEQ ID NO: 139157 - DNA, 1835 bp, Homo sapiens
  Payload ID: 7267
  Gene Symbol: GIMAP5
  Gene Name: GTPase, IMAP family member 5
  ENST ID: ENST00000498181
  CDS Start-End: 329-1252
gaggaggagggagtgtgcgcaggcgccctagggtcttccccagcacacgttgggaagaaggggtctgcaagcatgcgcacaattgccagctcaggctaaggactgcaggaggttccagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccaca

SEQ ID NO: 139158 - DNA, 3440 bp, Homo sapiens
  Payload ID: 7268
  Gene Symbol: GIMAP6
  Gene Name: GTPase, IMAP family member 6
  Uniprot ID: Q6P9H5
  ENST ID: ENST00000328902
  CDS Start-End: 218-1096
acttcctgttcctccatctccagcggacactgctctttcaagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattgcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggaacatggcagtggtgctgagacatggggagggttggagactgggtggggagggttggagactgggctgggaggagagcaagcaggaacagggatggaggcaggaggagcagcccttttattcactcttgagctgtaacaaacaagccccgttggaacttcctagtgggaatgatgggagaagtttggggcagggtatccaagaagtcagactgtggtcaagtaggtggtcccttgccctggctacagaacatggaagcccctagggatgcaagtggacttgggcagaggaggtcacaccaccccaccaaggtagacttagattagagatgacttgcatctgttacttcccctttttccatgggtttcatggcccctcatgatatttgccttctgctcctagaaggcacagactactttcaacctgcctcgcccttcactgccacccctcccttctcccttgataatgggagcatgtggatggggtgtctgcgtgtgcaaacgggttccctagcaaagtatttgtgggggtccaatgcaaggaggcagggaagaaagggggcctgcaaaggaagcagtagagtgacttaaacatcttgcgaggcagcctgcctggtttatgggagaactctgaagcccatgatgttttcctggaaggctgttcctacagacggggtttataagtactgatactggacaggatgagaagggagtaggatgtcatcctgtctcaggcctcggataggaagctgcctgccagcaagaggagactgatgtgccccgggtgcaccccacctcctttgaggtccaagatgctcctggggagttgaccgacatttgggaagataataggaggcattggggaaactgctccccaatatattcctcttttcctttcttcaagctgcgtagcagggggcctttagctagtttctcccgagaggggcgggaagtacagctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttgactataatgtgggagccaatttttgcctcagtcttcatttttatatttaccttgttattctcaggcatttttttcttctatgtgagagttaaaatcattctgtaatttccccccaaaatcatattggtattctagttggcaatgtcttacatttatgttaagtttgagggaattggtagttcaagtataagttaattaaggccattttatttctaagtgaacagacttgaaactccagagctactgaagtaaaagttagaatcatttgcattttcattcagataggagataattttgtaaattttgatgctattattttaactctattagcttaagtaatgtcataatagaaaacacaagcatttgaccaaatgagatccattcagcgactaactggcaaggcactcaaaacatgtcattcattaaatgttgtttttatttacctcaaa

SEQ ID NO: 139159 - DNA, 876 bp, Homo sapiens
  Payload ID: 7268
  Gene Symbol: GIMAP6
  Gene Name: GTPase, IMAP family member 6
  Uniprot ID: Q6P9H5
  ENST ID: ENST00000493969
  CDS Start-End: 179-367
aagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcac

SEQ ID NO: 139160 - DNA, 3910 bp, Homo sapiens
  Payload ID: 7268
  Gene Symbol: GIMAP6
  Gene Name: GTPase, IMAP family member 6
  ENST ID: ENST00000618759
  CDS Start-End: 481-1569
gagacaatgactgtttgccccaatactgaggcatagaagttccctggggaagaggtggggttcagaaaagagagatcagggaaagtcactcctcctgacacaaatctttctgaggcatctgcctctttttaagctctgagttctagttatcctggctcaggataaaaataatcccaccactggtatcctccctttttctacttccgaggctgcaaagtgcaacagcagactcttctgactcaggaaggccggtgctcctacccacttcctgttcctccatctccagcggacactgctctttcaagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggctctgctcttgcactgggagagaacgttcagccccaccttcaaggatgtgggcccagaatggtggcccagcgctggtttcagggcagatgttggtcttttacaatctgcccctgcagtctgggggtacacccagaggctcctggtgatgacaagatggggtacatgggcccttaccccagttccctctgctttctttggatatttctaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattgcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggaacatggcagtggtgctgagacatggggagggttggagactgggtggggagggttggagactgggctgggaggagagcaagcaggaacagggatggaggcaggaggagcagcccttttattcactcttgagctgtaacaaacaagccccgttggaacttcctagtgggaatgatgggagaagtttggggcagggtatccaagaagtcagactgtggtcaagtaggtggtcccttgccctggctacagaacatggaagcccctagggatgcaagtggacttgggcagaggaggtcacaccaccccaccaaggtagacttagattagagatgacttgcatctgttacttcccctttttccatgggtttcatggcccctcatgatatttgccttctgctcctagaaggcacagactactttcaacctgcctcgcccttcactgccacccctcccttctcccttgataatgggagcatgtggatggggtgtctgcgtgtgcaaacgggttccctagcaaagtatttgtgggggtccaatgcaaggaggcagggaagaaagggggcctgcaaaggaagcagtagagtgacttaaacatcttgcgaggcagcctgcctggtttatgggagaactctgaagcccatgatgttttcctggaaggctgttcctacagacggggtttataagtactgatactggacaggatgagaagggagtaggatgtcatcctgtctcaggcctcggataggaagctgcctgccagcaagaggagactgatgtgccccgggtgcaccccacctcctttgaggtccaagatgctcctggggagttgaccgacatttgggaagataataggaggcattggggaaactgctccccaatatattcctcttttcctttcttcaagctgcgtagcagggggcctttagctagtttctcccgagaggggcgggaagtacagctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttgactataatgtgggagccaatttttgcctcagtcttcatttttatatttaccttgttattctcaggcatttttttcttctatgtgagagttaaaatcattctgtaatttccccccaaaatcatattggtattctagttggcaatgtcttacatttatgttaagtttgagggaattggtagttcaagtataagttaattaaggccattttatttctaagtgaacagacttgaaactccagagctactgaagtaaaagttagaatcatttgcattttcattcagataggagataattttgtaaattttgatgctattattttaactctattagcttaagtaatgtcataatagaaaacacaagcatttgaccaaatgagatccattcagcgactaactggcaaggcactcaaaacatgtcattcattaaatgttgtttttatttacctc

SEQ ID NO: 139161 - DNA, 1256 bp, Homo sapiens
  Payload ID: 7269
  Gene Symbol: GIMAP7
  Gene Name: GTPase, IMAP family member 7
  Uniprot ID: Q8NHV1
  ENST ID: ENST00000313543
  CDS Start-End: 158-1060
ctgactgagaggttttggtggcggtacagacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatcta

SEQ ID NO: 139162 - DNA, 4184 bp, Homo sapiens
  Payload ID: 7270
  Gene Symbol: GIMAP8
  Gene Name: GTPase, IMAP family member 8
  Uniprot ID: Q8ND71
  ENST ID: ENST00000307271
  CDS Start-End: 575-2572
ggctttgctcagagcttgtagcggcgccacaatctctgtcctctcaggaacaggaactggcttgacgtccttttcctgccctatccaagcccctgttcttgcagcccttctgaagctcagcctggcaccggccccggcgccccagcccctggccaagcctctgctgtcatttctcctccctcctctcagtctgcagctgcgggacgggccgggctcctcagtttctgctgtgttgtgaccccacgaggcgctcagcacccagggaaggcgcgtgtgtccccgatgctggctcctccctgagccccgacggctctcgaggttctgagcctgtggcctgcacagggaacttcctctccgactgcatttatgcctctgtggatgtgaaggctatttctagaaatctcttcctttgcagaaacacccgaaaccctcctgccaggaagaccagggcctgggaagagggtcgctctccggccattctcccctcaccctcctcaccttcctcacatcctgtgccctgggggaccagcagctgcttccacccagaacaagcgggagcctgtgtcaggaaagcatgtcagagcagagctgccagatgtccgaactgcggctcctcctcctgggaaaatgccgctcgggaaaaagtgccacaggaaatgccattctgggcaaacatgtgttcaagtccaagttcagtgatcagacagtgatcaaaatgtgccagagagagagttgggtcctgagagaaaggaaggttgtggtaattgacacccctgaccttttctcctcaatagcttgtgctgaagacaagcaacgcaacatccaacactgcttggagctctctgctcccagcctccatgctctgctcttggtaattgccatcggccatttcacaagggaggatgaggaaacagccaagggcatccaacaagtgtttggagctgaagccaggaggcacatcattattgtcttcactcggaaggatgatttgggggatgacttgctgcaagatttcattgaaaaaaacaaacctctcaagcagttggttcaagactatgagggccgatactgcattttcaacaacaagaccaatagtaaggatgagcagatcacccaggtgttggagctccttcgcaaggttgagtctttggtgaatacgaacggaggaccctatcatgtgaacttcaaaactgaaggcagcaggtttcaagattgtgtgaatgaagctgcatctcaagagggagacaagccacagggcccaagggaaaggcagctgcagtccacaggacccgagcagaatccggggacatcagaactgacagtcctccttgtggggaaacgcggtgctggaaaaagtgcagcaggaaacagcattctggggaggcaggcctttcagaccggatttagtgagcagtcagtaacccagagcttcttgtctgagagcagaagctggagaaaaaagaaagtttcgatcattgatgctccggacatctcatctttaaagaacattgactcagaagttagaaaacacatctgtacaggcccccatgccttcctgctggtgacaccactgggcttttacactaagaatgatgaggcagtgctgagcaccatccaaaacaattttggagaaaaattctttgagtacatgatcatacttcttaccaggaaagaagatttaggggatcaggatctagatacgttcttaagaaacagcaataaagctctctatggtctcatccagaagtgtaaaaacagatatagtgccttcaactaccgggcaacaggagaagaagagcaaaggcaggcggacgagctcctggaaaaaattgagagcatggtgcatcagaatgggaacaagcattgtgttttcagagaaaaagaaaccctgaacattgtccttgtggggagaagcgggactgggaagagtgcgaccgggaactctatcctggggagcctcgtcttcacctctcggctccgggcccagccagtcaccaagaccagccagagtggcaggaggacatgggacggacaggaggtggtggttgtggacactccttccttcaaccagatgctggatgtcgaaaaggacccatcccggttagaagaggaggtcaagcgctgtttgtcctgctgtgaaaaaggggacacattttttgtcctggtgttccagctgggacgattcactgaagaggacaaaacagctgtggcgaaactggaggccatctttggagcagactttacgaaatacgcgattatgctgttcacccggaaggaagacctaggggcggggaatttggaagacttcatgaagaactcagataacaaagcccttcggcgcatttttaaaaagtgtgggcggcgagtttgtgcttttaacaacaaagaaacaggccaggcccaggaaacccaggtgaaagctcttttaacaaaggtcaatgatctgagaaaagaaagtgggtggtccgggtatccccatacacaggagaacgtcagcaaactaattaaaaatgtccaggaaatgtcccaagccgaaaaactccttaaaaatttaataggtattttacaataggtagccgaagtgcctggggtctcttcaattagagacaccctcaggttggggggaggggcggggcatggtacaacctgtgggaagggaagcgggttcatggctttgagggcctgagaggcaaatgcatcccgccttgtgatgtatcagctatttgtagataaataaattgcaggtgggggcgaatagtagggtattataaaggagaaagaagatacaaggtggggaaatctggaaaaagatttcagacattaggctgataataagtggtagaatcaagtcacaagaatcacctcacttgtgtaggtaggttggaatcaggatagacactgtgatcaaggctgaggccacctgggatgagaatatagatagtcgtacaacaacccaggggatccagatacatgagaccagggcagcgttcagcacactcctgggcatggcggaagcaggaagcagactccagagggcctccctgttgtccagggccgttggctccctgagctctcctgtctcctttgggatgcgacttagggctagagtgttcttttcttcacacgttagccattccttacggctcttcacgttccacgcctagatgtgaagtgggacatagtcttccattgctggctgtccctgaggaaacagacatgagtcttggaggttctgaatgattttattgctaattatcacagtgacatagactagaacagaaattagaagcatagtaagattgccaaaatcagagaatcttgcaaagttctgtaattctaagtgttgttctagatttcctctagagaaggttattagaatctccattgcgtttctctttctccttctctttcccttgaggttaggaaacaggttaaaactcagagaactccaataataatggtttaaaaacatcaggggcttcctgtatctcctgtcaggaagccgaggaataagcaggctggggctggtgggcgtcaacatcccagttttgttctatctttctgtcccacctgcactgggatgtggcttctacactcgaatttgcttcttggtttcaagacagtggtgttctttccatagctgagcagattattttgagaggtgggtgatatgtgagagagaaatctggaaccttcttctgggtagatacaggataagatagatacagggtaaaatgttgagcactttgtacatgctttgagagcataatctttgtcatctgtttttttcccctagacaatatcaggttaccgtcaacattaatccatttaaaaggacatggactgttgccattaatacttttggattccatataacccttaacacaataacttctagaaaatgtgtgtgccgtagacacaaagaagggaacaatagacaccagggtatacttgagggtggagggtggcaggagggtgaagattgaaaagctgcctattgcgtgttatgctggtttcctgggtgacaaaattacctgtacaccacacccctgtgacacacaacttactcatgtaacaaacctgtgcatgtaccccttgaacctgaaataaaaattggaaagtaaaaaaaagtgtgtaaatatatttagttgaatcaaataataaagatgaatcattatgaattc

SEQ ID NO: 139163 - DNA, 7531 bp, Homo sapiens
  Payload ID: 7271
  Gene Symbol: GTPBP10
  Gene Name: GTP-binding protein 10 (putative)
  Uniprot ID: A4D1E9
  ENST ID: ENST00000222511
  CDS Start-End: 67-1230
aaaaaggccgcgctgtactgcggcttgtgccgcttccgcaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattataggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccataccttttaaagttattattttgtaattaagtatgtcaacagtaaaaaataaccagtggccaggcatggtggctcatgcctgtaatcccagcacttttcggaggccgaggagggcagatcacttgaggtcaggagttcaagaccagcctggccaacatggcgaaaccccgtctctactaaaaatataaaaaattagccaggcatagtggcgcatgcctgttgtagccccagctactcaagaggctgaggcaggagaattgcttgaacgcgggaggtggaggatacaatgaacccgaggtcgcgccactgcacttcagcctgggtgacagagctagactccatctcaaaaaaaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagtacaaaagcatataagtaactaataaaagctccctttctgcattaggcccctcagttcttcccagggaaaatgattaatagtttacattcttgcagaaattttttatgtataaatttttacccaaatgaattcattatataaattttttccaacttagtgtttttttacataatagtagcaagttaaaaaattgtacttcaggccaggcacggtgggtcacgcctgttaatctcagcactttgggaggctgaggcaggaagaccacttgaggtcaggagttcaagaccagcctggccaacatggtgaaaacccatctctactaaaatacaaaaatcagctgggcatggtggcgcatgtctgtaatcccagctactcgggaggctgaggcaggagaatcgcttgaacccgggaggcggaggttgcagtgagctgagattgcgccattgcactccagcctggaggacaagagggagacttcctctcaaaaaacaaaatattgtacttcaaaaaattattcttcaatgctatttttaaattactagaaattattttggaatttaatgttgcatacagcctgagatatggctgttcaccctttggtaaagtattaaagaaaaataatgcattgttctcagcttaaatttttttctgatttgacaacatgagtgatgttttcccagtattatttcaattatatttgttttattttctgttcctcactcctacctctcattccagtccccaaactggcttttcttttatttcttttttcttcattgctgatgtatttattgagcaatgtcctgtatcaggcactgtccaaggtgctgtatgtgccatgttgaagagaacagacaggacctactgtccttgtatatcttgcctttgataacagaaactgcaggggattggaatagcctctttacaagaaaagaataagagtgaggaaaagcgtttggaatttatagtgatcacagtgaccaggttttgtattgggtatgttttacatttgtaacttcagtgctatttttttttaagctccattgttttctaaatgtaaacaagtatcaatgtaaggacagtttcatcaggtgaatatcagaagtactgacaccataatctcattttgcactgtggcaaagggtagtagatgtgtgttcaggattatttgctctgtcagtagtgcccagggtgccactccatgactaaccgaaacattttattatgtgactcactaagatgttcaattcattagtattttctggttactcaaagtgtactctatgtacctttttttgacctttgatttttattctgatggagaagatcagattccttttttatcttataaaaaataattttgaaacaaagacttattttgaagtaagtcttttaacattatctcagatgcattttattttgtccttaagtaagacttttcatttttacctttcaaaatgcaattttcaaaatatatgcttttttgaaacacttattatgttactgaataaccagagtattaaattcaatgtacagcaaatttttacaaagtcccagtagttcttgcagagctttctataatatcagatttatttaccatcatgaaatatgtttatacagtattaagtatattgtactatgaagttggacctgcacactgaaaaattccaaaatacctattatgttgtgctttttgtgatatatattcatattattatttgtcataacaaggtgaacttttttaaaatggtaaacatgtattagttacataatcaggaaaaaagtcatcttttataatgagaaaaattaggtcaaggatatttcaggttttatccaattagatttcttgtaaagttatgtgttttcttttatctcagtgcttatttgctttgcaaggatgaaggttagagattcctttcagtagttaatgaaagctacagacttgtcttgccgaaaaatgtacataaacacataaactattttccaagcagtttcacagtgtttgcaaagttcagattgaaaacccagttttacaaatcccatctacaaatttgcattgtcattaagatatattaaaaataatttttcaaagcaacagcacagatgcactttaaaactgtagcttaaaaataaaaattagtaatataacttgtgtaaacctacacaaaagataaaagatatcttattgcaaaaatagggcaacattttgttttaaagaccaaatagtgaattgaatttaatgcatatctttaaatccttaatagtatctcaaatctggtttaaatctgtctctccttaacggaatagaaagtgaaacaaatccagaaatcttgttcgagtacatggtctgtgctagtaatcatatctaaagtggtaatgttaccatatgctgggtactgggctgagtaaatcacatattttaacttatttaaacactgcactgtattgcctgctagcgatgtcatttttttaaagttggatggtgaatacatgagttgttttttaaactcttttgggagcctaaaaaatttgaatttttttttttccccccccagacggagtctcgctctcttgccaggctggagtgcagtgacattatcttggctcactgcagcctctgattccctggttcaagcaattctcctgcctcagcctcccgagtagctgggattacaggcatccaccaccacgtccagctaatttttgtatttttagtagagacggggtttcaccatgttggccaggatgggaaaattttttaaaagacatttattaaaaaaaaatgtctatgccttatcaaagtttataactcaagaattaatgagataaacagtggacaaaaagtgttggcagataacatgcataattttaattaaaagttaagcagtgaaaaataaacatctttttttcttaaagagatatttcatatctgttctatttgtttagttttatttattctttttagagacagggtctctctgtggagtgcagtggcatgattatagccctctgcggcctcaatcttcagggcttaagttatcctcctgcctcatcctcccaagtagctaggactacaagtgtgtgccaccatacctggctaatttttaaaaactattttgtagagacagggtcttactatgttgcccagagtggtcttgaactcccatcctcatggaatcctcccacttcagtctctgaaagtgctaggattataggcatgagccatttatgcccagccagttttcttttttctaattgaagcttggcaagcagagggaaatgtattagggaaatagctttagttttgagtgggtgtcagtagccagctgaagaaaaagcaaaatgaaataggtagtagaaatgagaaagggagagagggaagaagaaaaaaatggatgttggaaagttgttgcatgtctctctggatagctcagaagtatcagttgtggttattgcctcacttggcttttgtaagcatgaaaaagccagggacaatttcaactaccatttctgaccatcatcaaccacaaattttaggcaatttgttagaattttttttaaatgttcttaatagttgttgggtacctgggagatttcagagaaagtaatcacctttgtatatattattaatgtgtttataatagaaattaaattctttgggatgtacaggtaagataagctatgtgaagcatagctgttatccaagtcgtgtgcctttgaaatacttggaatttgaagaacaggacatgcagcttatgttataattaatttgcgagcaatatatggcatgatagtattttcttatctaaattctgagtgcattgaaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgctacaaattgagggagattgagaatattttaaatcaagggcagacattgagtaaaagcttatgactttggatggatttgaaacatgattaaatgacagagtaaataaaagcccctagtcaagtgaattctaatgggggaaataagaggactatataaaaattgaacctctgttttgaaaacaaatctttccaggaagtggtaccactctggggtcaagagaaattgtaagaacaataaaatgagcacacatgaccttcctttcctataaaaatatgaagcagaaaactcccccatgatttcctcatgttgcttagaatagtgtgtatttcagaacttttccatttaatatttttggaccacagttgactgaaactgaggatgggaggaagggatgcttaaaaccttggatagtaccaaaccctatatatattatgtttttttctatatatacacagctatgataaagttcataaattaggcacagtaagagattaaaaatattaaattgggccaattaatatattgtaataaaagctatgttaatgtggtc

SEQ ID NO: 139164 - DNA, 1740 bp, Homo sapiens
  Payload ID: 7271
  Gene Symbol: GTPBP10
  Gene Name: GTP-binding protein 10 (putative)
  Uniprot ID: A4D1E9
  ENST ID: ENST00000257659
  CDS Start-End: 78-1004
ggggatgacgtaaaaaggccgcgctgtactgcggcttgtgccgcttccgcaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccataccttttaaagttattattttgtaattaagtatgtcaacagtaaaaaataaccagtggccaggcatggtggctcatgcctgtaatcccagcacttttcggaggccgaggagggcagatcacttgaggtcaggagttcaagaccagcctggccaacatggcgaaaccccgtctct

SEQ ID NO: 139165 - DNA, 6913 bp, Homo sapiens
  Payload ID: 7271
  Gene Symbol: GTPBP10
  Gene Name: GTP-binding protein 10 (putative)
  Uniprot ID: A4D1E9
  ENST ID: ENST00000380058
  CDS Start-End: 36-386
gcttccgcaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattatagattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccataccttttaaagttattattttgtaattaagtatgtcaacagtaaaaaataaccagtggccaggcatggtggctcatgcctgtaatcccagcacttttcggaggccgaggagggcagatcacttgaggtcaggagttcaagaccagcctggccaacatggcgaaaccccgtctctactaaaaatataaaaaattagccaggcatagtggcgcatgcctgttgtagccccagctactcaagaggctgaggcaggagaattgcttgaacgcgggaggtggaggatacaatgaacccgaggtcgcgccactgcacttcagcctgggtgacagagctagactccatctcaaaaaaaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagtacaaaagcatataagtaactaataaaagctccctttctgcattaggcccctcagttcttcccagggaaaatgattaatagtttacattcttgcagaaattttttatgtataaatttttacccaaatgaattcattatataaattttttccaacttagtgtttttttacataatagtagcaagttaaaaaattgtacttcaggccaggcacggtgggtcacgcctgttaatctcagcactttgggaggctgaggcaggaagaccacttgaggtcaggagttcaagaccagcctggccaacatggtgaaaacccatctctactaaaatacaaaaatcagctgggcatggtggcgcatgtctgtaatcccagctactcgggaggctgaggcaggagaatcgcttgaacccgggaggcggaggttgcagtgagctgagattgcgccattgcactccagcctggaggacaagagggagacttcctctcaaaaaacaaaatattgtacttcaaaaaattattcttcaatgctatttttaaattactagaaattattttggaatttaatgttgcatacagcctgagatatggctgttcaccctttggtaaagtattaaagaaaaataatgcattgttctcagcttaaatttttttctgatttgacaacatgagtgatgttttcccagtattatttcaattatatttgttttattttctgttcctcactcctacctctcattccagtccccaaactggcttttcttttatttcttttttcttcattgctgatgtatttattgagcaatgtcctgtatcaggcactgtccaaggtgctgtatgtgccatgttgaagagaacagacaggacctactgtccttgtatatcttgcctttgataacagaaactgcaggggattggaatagcctctttacaagaaaagaataagagtgaggaaaagcgtttggaatttatagtgatcacagtgaccaggttttgtattgggtatgttttacatttgtaacttcagtgctatttttttttaagctccattgttttctaaatgtaaacaagtatcaatgtaaggacagtttcatcaggtgaatatcagaagtactgacaccataatctcattttgcactgtggcaaagggtagtagatgtgtgttcaggattatttgctctgtcagtagtgcccagggtgccactccatgactaaccgaaacattttattatgtgactcactaagatgttcaattcattagtattttctggttactcaaagtgtactctatgtacctttttttgacctttgatttttattctgatggagaagatcagattccttttttatcttataaaaaataattttgaaacaaagacttattttgaagtaagtcttttaacattatctcagatgcattttattttgtccttaagtaagacttttcatttttacctttcaaaatgcaattttcaaaatatatgcttttttgaaacacttattatgttactgaataaccagagtattaaattcaatgtacagcaaatttttacaaagtcccagtagttcttgcagagctttctataatatcagatttatttaccatcatgaaatatgtttatacagtattaagtatattgtactatgaagttggacctgcacactgaaaaattccaaaatacctattatgttgtgctttttgtgatatatattcatattattatttgtcataacaaggtgaacttttttaaaatggtaaacatgtattagttacataatcaggaaaaaagtcatcttttataatgagaaaaattaggtcaaggatatttcaggttttatccaattagatttcttgtaaagttatgtgttttcttttatctcagtgcttatttgctttgcaaggatgaaggttagagattcctttcagtagttaatgaaagctacagacttgtcttgccgaaaaatgtacataaacacataaactattttccaagcagtttcacagtgtttgcaaagttcagattgaaaacccagttttacaaatcccatctacaaatttgcattgtcattaagatatattaaaaataatttttcaaagcaacagcacagatgcactttaaaactgtagcttaaaaataaaaattagtaatataacttgtgtaaacctacacaaaagataaaagatatcttattgcaaaaatagggcaacattttgttttaaagaccaaatagtgaattgaatttaatgcatatctttaaatccttaatagtatctcaaatctggtttaaatctgtctctccttaacggaatagaaagtgaaacaaatccagaaatcttgttcgagtacatggtctgtgctagtaatcatatctaaagtggtaatgttaccatatgctgggtactgggctgagtaaatcacatattttaacttatttaaacactgcactgtattgcctgctagcgatgtcatttttttaaagttggatggtgaatacatgagttgttttttaaactcttttgggagcctaaaaaatttgaatttttttttttccccccccagacggagtctcgctctcttgccaggctggagtgcagtgacattatcttggctcactgcagcctctgattccctggttcaagcaattctcctgcctcagcctcccgagtagctgggattacaggcatccaccaccacgtccagctaatttttgtatttttagtagagacggggtttcaccatgttggccaggatgggaaaattttttaaaagacatttattaaaaaaaaatgtctatgccttatcaaagtttataactcaagaattaatgagataaacagtggacaaaaagtgttggcagataacatgcataattttaattaaaagttaagcagtgaaaaataaacatctttttttcttaaagagatatttcatatctgttctatttgtttagttttatttattctttttagagacagggtctctctgtggagtgcagtggcatgattatagccctctgcggcctcaatcttcagggcttaagttatcctcctgcctcatcctcccaagtagctaggactacaagtgtgtgccaccatacctggctaatttttaaaaactattttgtagagacagggtcttactatgttgcccagagtggtcttgaactcccatcctcatggaatcctcccacttcagtctctgaaagtgctaggattataggcatgagccatttatgcccagccagttttcttttttctaattgaagcttggcaagcagagggaaatgtattagggaaatagctttagttttgagtgggtgtcagtagccagctgaagaaaaagcaaaatgaaataggtagtagaaatgagaaagggagagagggaagaagaaaaaaatggatgttggaaagttgttgcatgtctctctggatagctcagaagtatcagttgtggttattgcctcacttggcttttgtaagcatgaaaaagccagggacaatttcaactaccatttctgaccatcatcaaccacaaattttaggcaatttgttagaattttttttaaatgttcttaatagttgttgggtacctgggagatttcagagaaagtaatcacctttgtatatattattaatgtgtttataatagaaattaaattctttgggatgtacaggtaagataagctatgtgaagcatagctgttatccaagtcgtgtgcctttgaaatacttggaatttgaagaacaggacatgcagcttatgttataattaatttgcgagcaatatatggcatgatagtattttcttatctaaattctgagtgcattgaaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgctacaaattgagggagattgagaatattttaaatcaagggcagacattgagtaaaagcttatgactttggatggatttgaaacatgattaaatgacagagtaaataaaa

SEQ ID NO: 139166 - DNA, 856 bp, Homo sapiens
  Payload ID: 7271
  Gene Symbol: GTPBP10
  Gene Name: GTP-binding protein 10 (putative)
  ENST ID: ENST00000450619
  CDS Start-End: 149-856
tccagggaaatcaagagatggagaaattggcccaccaaccactttggtggtaaaagaggagagtttcctttgtgattggcccgcgctcctaaatttgcccaagtaaaatctacatgagtgtttcccacgacttggaggtggattgcatatgaggacagtctcactctgtcacccagactggagtgcattggcatcatcatggcttactgcagcctcaacctcctgggctcagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattataggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaa

SEQ ID NO: 139167 - DNA, 778 bp, Homo sapiens
  Payload ID: 7271
  Gene Symbol: GTPBP10
  Gene Name: GTP-binding protein 10 (putative)
  ENST ID: ENST00000426366
  CDS Start-End: 149-778
tccagggaaatcaagagatggagaaattggcccaccaaccactttggtggtaaaagaggagagtttcctttgtgattggcccgcgctcctaaatttgcccaagtaaaatctacatgagtgtttcccacgacttggaggtggattgcatatgaggtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattataggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaa

SEQ ID NO: 139168 - DNA, 636 bp, Homo sapiens
  Payload ID: 7271
  Gene Symbol: GTPBP10
  Gene Name: GTP-binding protein 10 (putative)
  ENST ID: ENST00000453512
  CDS Start-End: 149-472
tccagggaaatcaagagatggagaaattggcccaccaaccactttggtggtaaaagaggagagtttcctttgtgattggcccgcgctcctaaatttgcccaagtaaaatctacatgagtgtttcccacgacttggaggtggattgcatatgaggtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattatagattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattc

SEQ ID NO: 139169 - DNA, 686 bp, Homo sapiens
  Payload ID: 7271
  Gene Symbol: GTPBP10
  Gene Name: GTP-binding protein 10 (putative)
  ENST ID: ENST00000421719
  CDS Start-End: 149-361
tccagggaaatcaagagatggagaaattggcccaccaaccactttggtggtaaaagaggagagtttcctttgtgattggcccgcgctcctaaatttgcccaagtaaaatctacatgagtgtttcccacgacttggaggtggattgcatatgaggtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaagagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaa

SEQ ID NO: 139170 - DNA, 775 bp, Homo sapiens
  Payload ID: 7271
  Gene Symbol: GTPBP10
  Gene Name: GTP-binding protein 10 (putative)
  ENST ID: ENST00000417207
  CDS Start-End: 48-775
gcggcttgtgccgcttccgcaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattatagttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgt

SEQ ID NO: 139171 - DNA, 545 bp, Homo sapiens
  Payload ID: 7271
  Gene Symbol: GTPBP10
  Gene Name: GTP-binding protein 10 (putative)
  ENST ID: ENST00000439832
  CDS Start-End: 13-252
cctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaagagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgtt

SEQ ID NO: 139172 - DNA, 679 bp, Homo sapiens
  Payload ID: 7272
  Gene Symbol: GTPBP8
  Gene Name: GTP-binding protein 8 (putative)
  Uniprot ID: Q8N3Z3
  ENST ID: ENST00000295864
  CDS Start-End: 14-379
ctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagcttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaa

SEQ ID NO: 139173 - DNA, 1787 bp, Homo sapiens
  Payload ID: 7272
  Gene Symbol: GTPBP8
  Gene Name: GTP-binding protein 8 (putative)
  Uniprot ID: Q8N3Z3
  ENST ID: ENST00000383677
  CDS Start-End: 16-771
ttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtattttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatgggacagtttagactgctacatttaagattcagaatggaaaaataaagcctttgaactaaagttaatagagaagatttttgtgaaggtgccactaacctattcatgtaagtggcttaggttttcaaagtgaagcttaatattaaaaggttatagctg

SEQ ID NO: 139174 - DNA, 1360 bp, Homo sapiens
  Payload ID: 7272
  Gene Symbol: GTPBP8
  Gene Name: GTP-binding protein 8 (putative)
  Uniprot ID: Q8N3Z3
  ENST ID: ENST00000383678
  CDS Start-End: 83-937
gcgtcgcggcagcgggaagtcacgcacgcgcaacccaggccacaggagtaaaatctctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtattttttttttaaatgttaaaatgggctaggtaaaagggggctgcttttctgttaagcatcgataggta

SEQ ID NO: 139175 - DNA, 686 bp, Homo sapiens
  Payload ID: 7272
  Gene Symbol: GTPBP8
  Gene Name: GTP-binding protein 8 (putative)
  ENST ID: ENST00000467752
  CDS Start-End: 139-660
tttgcggttgtattttctagctttatgttggcgcatatattattttaactcaataggcatatgtcgatgctccctgtacgtggggatacccgagaaacccattgttaagtacaaaatgcagtcaatacccataaacccatggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattca

SEQ ID NO: 139176 - DNA, 715 bp, Homo sapiens
  Payload ID: 7272
  Gene Symbol: GTPBP8
  Gene Name: GTP-binding protein 8 (putative)
  ENST ID: ENST00000488781
  CDS Start-End: 37-456
cccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaa

SEQ ID NO: 139177 - DNA, 1518 bp, Homo sapiens
  Payload ID: 7272
  Gene Symbol: GTPBP8
  Gene Name: GTP-binding protein 8 (putative)
  ENST ID: ENST00000473129
  CDS Start-End: 1089-1493
aaaaatcgttaagtcgacccactgtaagcagagactgcctgtatacagcttaaattattttggaatgaatatagaagacttcaaaatgctttaaaagcttttcaaacccaaattaagcattcaaaaaattaactctccttttttcttctatttaacttaagtagggaaaacatgccagacaaattagacagaatttagacagtgaagaataggaaacgaataatagtttcacaaatgagatggtccttatcaataagtaactttcgcctaatctaaatttcctatcgtgcaaaaataataatctctagatggcaataatgtggaaaaatttttataacaacgtttattagtgaaatttcatgagtgagcattcttgcatgtcctacaatttattgatattctgttctaagtctgctaaaaggcatctcaactctccatatgtatttacactaagtgcaccattgcccagagatatttcgtctaaatatatgtggaactatagtcaggattcaaagagtacctcaattatttaatgattttgagacagccattgcttttttatttaagcttctaaattactggacttttttgtaattcgtttttaaaattcagttttatctacatattagcattagatttgctctggcagagcatttaaaatttttgcaggactcagatcaattaattttgaagaactgaccagaattttccaggataggatccctggcccctgcccactaaatgtcccccaattgtcttgataaccaaaaatgcccttaaaatctccaaaatgtccctcaaggggcagtacggccgtcatttagaacaactgattggcattgtaccccctcccccaataccatgttcaaaagcagagccatgtgtattaatggttattatcgagaatattctgttgttttccacactacagaggagacaagcttaattggaacaagagaggtcaagggaaaagagtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattc

SEQ ID NO: 139178 - DNA, 1635 bp, Homo sapiens
  Payload ID: 7272
  Gene Symbol: GTPBP8
  Gene Name: GTP-binding protein 8 (putative)
  Uniprot ID: Q8N3Z3
  ENST ID: ENST00000485330
  CDS Start-End: 10-765
gaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttatggagtctcactctgtcgcccaggctgcagtgcagtggcgtgatctcggctcactgcaagctccacctcctgggttcacaccattctcctgcctcagccttccaagcagctgggactacaggcacccgccaccacgccaggctaattttttgtatttttagtagagacggggtttcaccgtgtttgccaggatggtctcgatctggaccttgtgatccgcccacctcggcctcccaaagtgctgggattacaggcatgagccaccgcgcctggccgacaacatgatttttaatagtgaaactattaaaacaagatagaaaattattaactactaaatttcaacagtctataaagtaccacagagatgaggaaaacgattggctttaatcactgaacaaatatattctttgattagatgaagcttgttcttatgttcctctgcatcttctctctttctcccttctctctcttgggttttttttctcttttgaaccgcagttcacttactatgttttccaagtgctttaccatctgggtttgtcaatacctccctcaaaggatggtgtccagacttgaaaactgaaaaagataggagctgaccctaaagaatttaaggattgttccctccattattcttgaaaaccgctgttaaaacagaatccataaccttggttcaatttcta

SEQ ID NO: 139179 - DNA, 964 bp, Homo sapiens
  Payload ID: 7272
  Gene Symbol: GTPBP8
  Gene Name: GTP-binding protein 8 (putative)
  ENST ID: ENST00000618381
  CDS Start-End: 16-939
ttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgagaggcgattctacggttcacctgcgcgccggcgtcacagcgctaccgcttcctggccgtccggctcgcggtgtgttttataggcagagcaatgttggaaaatcatctctaatcaagctttattttcactggcccctgaggttgaagtcagagtctccaaaaaaccaggacacacaagaaaatgaatttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattc

SEQ ID NO: 139180 - DNA, 1378 bp, Homo sapiens
  Payload ID: 7272
  Gene Symbol: GTPBP8
  Gene Name: GTP-binding protein 8 (putative)
  ENST ID: ENST00000619116
  CDS Start-End: 1-924
atggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgagaggcgattctacggttcacctgcgcgccggcgtcacagcgctaaccttccctggccgtccggctcgcggtgtgttttataggcagagcaatgttggaaaatcatctctaatcaagctttattttcactggcccctgaggttgaagtcagagtctccaaaaaaccaacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtattttttttttaaatgttaaaatgggctaggtaaaagggggctgcttttctgttaagcatcgataggtaagttgatggataaaagttactatgtaagcct

SEQ ID NO: 139181 - DNA, 1193 bp, Homo sapiens
  Payload ID: 7273
  Gene Symbol:
  Gene Name: GU182339.12
  ENST ID: ENST00000620545
  CDS Start-End: 37-951
ctaggggtgcggccgcctgtctgctccggcaccaccatgtcgctcatggtcatcagcatggcatgtgttgggttcttctggctgcagggggcctggccacatgagggattccgcagaaaaccttccctcctggcccacccaggtcgcctggtgaaatcagaagagacagtcatcctgcaatgttggtcagatgtcatgtttgagcacttccttctgcacagagaggggacgtttaacgacactttgcgcctcattggagagcacattgatggggtctccaaggccaacttctccatcggtcgcatgaggcaagacctggcagggacctacagatgctacggttctgttcctcactccccctatcagttttcagctcccagtgaccctctggacatcgtgatcacaggtctatatgagaaaccttctctctcagcccagccgggccccacggttctggcaggagagagcgtgaccttgtcctgcagctcctggagctcctatgacatgtaccatctatccacggagggggaggcccatgaacgtaggttctctgcagggcccaaggtcaacggaacattccaggccgactttcctctgggccctgccacccaaggaggaacctacagatgcttcggctctttccatgactctccctacgagtggtcaaagtcaagtgacccactgcttgtttctgtcacaggaaacccttcaaatagttggccttcacccactgaaccaagctccaaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagt

SEQ ID NO: 139182 - DNA, 1244 bp, Homo sapiens
  Payload ID: 7274
  Gene Symbol:
  Gene Name: GU182343.1
  ENST ID: ENST00000612095
  CDS Start-End: 1-880
aggagtccacagaaaaccttccctcctggcccacccaggtctcctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtcccaacaaaaagaatgctgttgtaatggaccaagagcctgcagggaacagaacagtgaacagggaggactctgatgatcaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccaccagcaccacagtcaggccttgatgggatcttctagggagacaacagccctgtctcaaaaccgggttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacaattctccatttcacttgacccctgcccacctctccaacctaactggcttacttcctagtctacttgaggctgcgatcacactgagg

SEQ ID NO: 139183 - DNA, 1193 bp, Homo sapiens; identical to SEQ ID NO: 139181
  Payload ID: 7275
  Gene Symbol:
  Gene Name: GU182347.12
  ENST ID: ENST00000618755
  CDS Start-End: 37-951

SEQ ID NO: 139184 - DNA, 1294 bp, Homo sapiens
  Payload ID: 7276
  Gene Symbol:
  Gene Name: GU182353.5
  ENST ID: ENST00000622568
  CDS Start-End: 2-988
catgtcgctcatggtcgtcagcatggcgtgtgttgggttcttcttgctgcagggggcctggccacatgagggtggtcaggacaagcccttcctctctgcctggcccagccctgtggtgtctgaaggagaacatgtggctcttcagtgtcgctctcgtcttgggtttaacgaattcagtctgtccaaagaagacggggtgcctgtccctgagctctacaacagagtattccgaaacaccgttttcataggccctgtgaccccagcacatgcagggacctacagatgtcggggttcacacccacacttcctcactgggtggtcagcacccagcaaccccctggtgatcatggtcacaggagtccacagaaaaccttccctcctggcccacccaggtcccctggtgaaatcagaagagacagtcatcctgcaatgttggtcagatgtcatgtttgagcacttccttctgcacagagaggggaagtttaatgacactttgcgcctcactggagagctccatgatggggtctccaaggccaacttctccatcggtcgcatgacgcaagaccttgcagggacctacagatgctacggttctgttcctcattccccctatcagttgtcagctcccagtgaccctctggacatcgtgattacaggtctatgtgggaaaccttctctctcagcccagccgcgccccatggttaaggcaggagagagcgtgaccttgtcctgcagctcccggagctcctatgacatctaccatctatcaagggagggggaggctcatgaacttaggttccctgcagtgcccaaggtcaatggaaccttccaggccaactttcctctgggccctgccacccacggagggacctacagatgcttcggctctttccgtgactctccctacgagtggtcagaccttagtgacccactgcttgtttctgtcacagattctatgaaggagaaaggaaaagatgtgatactgtaattttgctccatttgtctaaaatgagtaggctgcaactcctcttgaagtgataccttttctagctcttgttggaggtgtctcaggactcattacttcggggaacctgcaactgtgtcagtctggggaaactgcaaatattcttgtcttacatttgtctccagccaattgtgatggactccagtgacctgcaattgctgttattgcaggtaaaatgtacctgagtcaggccacagttctcctggactatgagcccctggccatgttcctgaggcaattctgttcatctaaatataataataataacac

SEQ ID NO: 139185 - DNA, 1294 bp, Homo sapiens
  Payload ID: 7277
  Gene Symbol:
  Gene Name: GU182355.5
  ENST ID: ENST00000611199
  CDS Start-End: 2-988
catgtcgctcatggtcgtcagcatggcgtgtgttgggttcttcttgctgcagggggcctggccacatgagggtggtcaggacaagcccttcctctctgcctggcccagccctgtggtgtctgaaggagaacatgtggctcttcagtgtcgctctcgtcttgggtttaacgaattcagtctgtccaaagaagacgggatgcctgtccctgagctctacaacagagtattccgaaacaccgttttcataggccctgtgaccccagcacatgcagggacctacagatgtcggggttcacacccacacttcctcactgggtggtcagcacccagcaaccccctggtgatcatggtcacaggagtccacagaaaaccttccctcctggcccacccaggtcccctggtgaaatcagaagagacagtcatcctgcaatgttggtcagatgtcatgtttgagcacttccttctgcacagagaggggaagtttaatgacactttgcgcctcactggagagctccatgatggggtctccaaggccaacttctccatcggtcgcatgacgcaagaccttgcagggacctacagatgctacggttctgttcctcattccccctatcagttgtcagctcccagtgaccctctggacatcgtgattacaggtctatgtgggaaaccttctctctcagcccagccgcgccccatggttaaggcaggagagagcgtgaccttgtcctgcagctcccggagctcctatgacatctaccatctatcaagggagggggaggctcatgaacttaggttccctgcagtgcccaaggtcaatggaaccttccaggccaactttcctctgggccctgccacccacggagggacctacagatgcttcggctctttccgtgactctccctacgagtggtcagaccttagtgacccactgcttgtttctgtcacagattctatgaaggagaaaggaaaagatgtgatactgtaattttgctccatttgtctaaaatgagtaggctgcaactcctcttgaagtgataccttttctagctcttgttggaggtgtctcaggactcattacttcggggaacctgcaactgtgtcagtctggggaaactgcaaatattcttgtcttacatttgtctccagccaattgtgatggactccagtgacctgcaattgctgttattgcaggtaaaatgtacctgagtcaggccacagttctcctggactatgagcccctggccatgttcctgaggcaattctgttcatctaaatataataataataacac

SEQ ID NO: 139186 - DNA, 1704 bp, Homo sapiens
  Payload ID: 7278
  Gene Symbol:
  Gene Name: GU182357.6
  ENST ID: ENST00000619479
  CDS Start-End: 57-1253
ctgtgcgctgctgagctgagctaggggtgcggccgcctgtctgctccggcaccaccatgtcgctcatggtcatcagcaaggcgtgtgttgcgttcttcttgctgcagggggcctggccacatgagggtggtcaggacaagcccttgctttctacctggcccagccttgtggtgcctccagaacatgtgactcttcggtgtcactctaatcttgggtttaacaacttcagtctgtacaaggatgatggggtgcctgtccctgagctctacaacagaatattctggaaaagccttttcatgggccctgtgaccccgtcacacacagggacctatagatgccggggttcacacacacactcccccagtggggggtcggcacccagcaaccccctggtgatcgtggtcacaggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggaccaaggtcaacggaacattccaggccgactttcctctggaccctgccacccacggagggacctacagatgcttcggctctttccgtgactctccatacgagtggtcaaagtcaagtgacccactgcttgtttctgtcacaggaaactcttcaaatagttggccttcacccactgaaccaagctccgaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccagcagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagtcttcatcttaggggatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgagg

SEQ ID NO: 139187 - DNA, 1601 bp, Homo sapiens
  Payload ID: 7278
  Gene Symbol:
  Gene Name: GU182357.6
  ENST ID: ENST00000622741
  CDS Start-End: 39-1088
gagctggggcgcggctgcctgtctgcaccggcagcaccatgtcgctcatggtcgtcagcatggcgtgtgttgggttcttcttgctgcagggggcctggacacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggaccaaggtcaacggaacattccaggccgactttcctctggaccctgccacccacggagggacctacagatgcttcggctctttccgtgactctccatacgagtggtcaaagtcaagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcgtcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaacgtgcctctctcttgcttacaaatgtctaaggtccccactgcctgctggagagaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctcatggt

SEQ ID NO: 139188 - DNA, 1053 bp, Homo sapiens
  Payload ID: 7279
  Gene Symbol: GAMT
  Gene Name: guanidinoacetate N-methyltransferase
  Uniprot ID: Q14353
  ENST ID: ENST00000252288
  CDS Start-End: 68-778
caagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttctctgtgagggtcactgctgcccactgcagggtccctgaggtgaagtaaacgccggcgctgggcttggccagtcggcagtgagcgtg

SEQ ID NO: 139189 - DNA, 1327 bp, Homo sapiens
  Payload ID: 7279
  Gene Symbol: GAMT
  Gene Name: guanidinoacetate N-methyltransferase
  Uniprot ID: Q14353
  ENST ID: ENST00000447102
  CDS Start-End: 95-904
gggcctgttggacccgcccccggcccacaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggtgcgcccacctgaagttccccatgggtctccaggaagtgaccttggatgggggtgggaaggggctgctggagccaccttgctacctggggagggtcccttcctgaccccctgggtgggctggactgtgctggttcatttagaaatcaaagtcctttgcctggcgcagtggctgccaggagcagtggctcaggtctataatcccagcactgtggaaggccgaggtgggcagattgcttgagcctaggagttcaagaccagcctgggctacagagcaagacctcatctttcctaaaaaaaaaaaatacaaaaaactagctgggcgtggtggcgtgtgcctgtactcccagctacttgggaggctgaggtaggaggattgcttgggccccaggggcagaggttgcagtgagcccagatcgaaccactgcactccagcctgggtaacagagccagaccctgtctcaagaaaaaagaaagaaagaaagaaagaaagaaaatttaaaaaaaaaatggaaatcaggctgggcgtggtggctcacacctgtgatcccggcacttcggaaggccaaggcgggtggatcacttgagcccaggagtttgagcctagcctggccaacatggcagaatcccatctctactaaaaatacaaaagttagccaggcgt

SEQ ID NO: 139190 - DNA, 403 bp, Homo sapiens
  Payload ID: 7279
  Gene Symbol: GAMT
  Gene Name: guanidinoacetate N-methyltransferase
  ENST ID: ENST00000591788
  CDS Start-End: 1-327
cagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgagtggctgccaggagcagtggctcaggtctataatcccagcactgtggaaggccgaggtgggcagattgcttgagcctaggagttcaagaccagcctgggctacagagcaagacctcatctttcctaaaaaaaaaaaatacaaaaaacta

SEQ ID NO: 139191 - DNA, 2074 bp, Homo sapiens
  Payload ID: 7280
  Gene Symbol: GDA
  Gene Name: guanine deaminase
  Uniprot ID: Q9Y2T3
  ENST ID: ENST00000238018
  CDS Start-End: 210-1625
agaaaaatcctattggcattgaggaggtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtt

SEQ ID NO: 139192 - DNA, 5340 bp, Homo sapiens
  Payload ID: 7280
  Gene Symbol: GDA
  Gene Name: guanine deaminase
  Uniprot ID: Q9Y2T3
  ENST ID: ENST00000358399
  CDS Start-End: 94-1458
cggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 139193 - DNA, 1771 bp, Homo sapiens
  Payload ID: 7280
  Gene Symbol: GDA
  Gene Name: guanine deaminase
  ENST ID: ENST00000376986
  CDS Start-End: 230-1411
agcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaatgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaacagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttac

SEQ ID NO: 139194 - DNA, 990 bp, Homo sapiens
  Payload ID: 7280
  Gene Symbol: GDA
  Gene Name: guanine deaminase
  ENST ID: ENST00000436438
  CDS Start-End: 1-540
gaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 139195 - DNA, 694 bp, Homo sapiens
  Payload ID: 7280
  Gene Symbol: GDA
  Gene Name: guanine deaminase
  ENST ID: ENST00000414671
  CDS Start-End: 109-694
cagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagactgtcactctgtcacccaggctggagtgcaatggcgcgatctcagctcactgaaacctccacctcctgtgttcaagagattctcctgcctcagcctcccgagtagctgggattacagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacag

SEQ ID NO: 139196 - DNA, 888 bp, Homo sapiens
  Payload ID: 7280
  Gene Symbol: GDA
  Gene Name: guanine deaminase
  ENST ID: ENST00000489618
  CDS Start-End: 1-530
acggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggaaagaaacaattcacttaccagcctcctcaccccatcctccaccatttccttaatgttccatggtattttcaacggaatacactttgaaaggctgatcttgatatcctggtctcaagtgatcctcccacctcagcattctaaagtgctaggattacagacatgagctactgcacccagccaattggaggccttgccccagcaggtggggaaggaaatgccagccaagttcccaccacatgcagaaacctgagagggtgaaccctacccatcaacacctggagaccttttcctg

SEQ ID NO: 139197 - DNA, 2019 bp, Homo sapiens
  Payload ID: 7280
  Gene Symbol: GDA
  Gene Name: guanine deaminase
  Uniprot ID: Q9Y2T3
  ENST ID: ENST00000475764
  CDS Start-End: 86-1450
gcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 139198 - DNA, 5362 bp, Homo sapiens
  Payload ID: 7280
  Gene Symbol: GDA
  Gene Name: guanine deaminase
  Uniprot ID: Q9Y2T3
  ENST ID: ENST00000545168
  CDS Start-End: 339-1481
attctcccgcctcagtctcctgagtagccgggactacaggcacccgctacaacgcccggctaattttttttgtatttccccttccttctttgctttcaaaatccaggcttaggggtacaaaaacctatattgtctgagacaggaagcactccgaagtttgaagaagagggcagcagcccaactcagaagaactggactccccagcactataaggagagagggtggtggttccaccagagatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtt

SEQ ID NO: 139199 - DNA, 2024 bp, Homo sapiens
  Payload ID: 7281
  Gene Symbol: GMPS
  Gene Name: guanine monophosphate synthase
  Uniprot ID: P49915
  ENST ID: ENST00000295920
  CDS Start-End: 222-2006
agcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctatt

SEQ ID NO: 139200 - DNA, 8751 bp, Homo sapiens
  Payload ID: 7281
  Gene Symbol: GMPS
  Gene Name: guanine monophosphate synthase
  Uniprot ID: P49915
  ENST ID: ENST00000496455
  CDS Start-End: 336-2417
gagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaagtaccgtgtgcagtttaaattgattagaaatcattcccattattgacatgcagtactgtgaaaagagttactggagcagctacatcacatctgagttctccacagcaaaaatctacggcttaagagctgagttggggataaccaaaagggactgaagagtttgtacgggtaaataatcaaagcaccattgcctacactcagacagattgatactgcttttgcctttgcctcacttattctttatgtataaattcactgttgatgtctctgtgaatatgtatgaaggtgggtgaatttgggggtaattatgggcttctgtctccttaccagtttctaagaactgttagaaacgcccattatttaccagtgttacttactacttatatatactttttggagaatcagttttcttataagtaatcttatttctccaaagggtgaaaaagagatgaacatatcagataaaggtataggtgggctattccagccacttttgaaggacactgagggtataaaatgtaagctaccataagatggaaaagcaccaggaatttgttgatgtacttttgaattttatttcacagccttgggaggaagaaactatgagtggtctcagatgtctatgaatggtcttaaaatgttttcaaaccatgttccacatagatgccatgttattcaatgtcagcttgtttattagtaaggagctttatcctcctagccttatattaccagccccccacagccttgcatagaaagtttctgttatctccttagaagaaactggctcaatgacgtttctggtgtagtgcagatagaggtcaagaggagcattttcatctcttcttttgctggtcagagaaacggttctgagatcacagaagctatgatgcatacctacagcttacaaaagggagaggaaaaatgtttatatcatctagtaaacagttgtaaaatgagcttttaaatctaatctatagacatattattcattgctcagacacctgtgaacagtcttgatacatgcaagatgtttgccaaactttgtaatcctttctactagctataagagaggatttaagaactggtgtaggacttgttgccatcaccaccagtttctaacagatcttttataacattcacataagtactgtagacagtagtagacttaaactctccgtttctctcagtattttagctaagaatgttaccatatttttctcttaacaattccatctcaggttgctgctgcttgtctagtttaaaaggtcagatctattaatcaggaatgaaattttatttgggattcagtgttagacaaacaacaaaatgatgcgtggcagaagtcatctttttattctggctggtccagggaacaagaaaactgctgctggaccagcaagggaagagtttctgtctgtcttaacagaaatctgtccccaagacaaaggggtacttgactcctacaaaacttaaagggtacattctctatctgatgaggaggtactcattatggccttctggaaagaggctatgttagtgatctggtctttacagatttagagtcatgttatttgaaagctagaatagacaacctataaaatgcttaccaacatgtgtcagtacacgtttatgtttatatgaaaaaaaatttctagccacagtgtcttatgattttgtattgaagcaaacagtaggaattttggaaaaatagagagtaagaatgtgtgttctatggaacactgctccactgagaaggtccatgtaaaaaggattaggtggtcatataagtttggggaacataagctcacttgtcctttcctggagattcatggtatataatattcaaagctctgagaaattctgaagttaaaaacaattgttaaattctgcttaaattagtgttttcctgatatttgttttttgaacaccttttatataatcccttctaatatatacttagtatatacttaatataatattgggaaaattgttactccaaagcacatcttgacatgacatagtttcttaaaaatccaaattttctggaactcagaaatttcctaatatttagcacactgtcttcttttgcacagcactttttgctttgtgccatatagcattactctgtaccttcacagtatttcatctgagccactgaggaaagttaaaggttgcacttccattttacagttaagaaaacaagctcaccttaggcatggttacttaattaatttcagaattaaatttcaggtttccttagtccagattgtcctgatgtgtattctgacacctaaaattatataaacatttatgggatgcttattttactaagactagaatggtggctacctggctaataacattcatcattggttattctgggcatatcatgactttattcccgttgcttaccatctacctgggacacatctctctttgattaaatatattctttttctttgtactttttaggtagacagagaatgtagatcattgaaagcattatttattcctaagattggcaggcacagaatcatttttaagaaccaaatacccagtcctgccttaaaggccacatctatgatcatcagctctgttagaaataacagcctggcataattcctaaatacaagtctgtagatatatccaggagatagggttacactgttttctaaccttttttaaatcccttaatcttgaggtaaactgcatgcatttagtcaaacaagcatcataaaatttgtttcctcactgtttgggcttaacctcctgatagcctgttttactgaataacttgaccctaacctgtagagaataagagcattcaaattaggaaggcaggactatccatctttagtgcttttcctgccgttaaacaacaatgtgaacttggtcaagtcatttctgttctttatctgtgacatgaggtaactgtattaaattttcagcatcaaatccagctataaatttgtattttgtaaacaagagaaagtaaagcaggagacagaatggagaagctggatagtgttttttttttttttttttaaggttcttttatcatcagatatgacacaaagggaaacatcaaaatgcaccgtaaagttaaatcctagttacctttttttgaagctgttggcaaggtttgaccacttggggcatcttctgctgtgagatgacacttgaaaaacacccatcaaagttttcctggtaggaatctctctttactgcgtgtttttttgaaaagctgacagagaatatgctttggctttgacactaatgaagtcacccatcatcaattacatacagctaattgttgggagctagagctagaatccaagctttctgattctctgcatggaagaggaaatgctctagggcccttcagggcaaatcttaaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattagctgggcgcggtggcgggtgcctgtagtcccagctactcgggaggctgaggcaggagaatggcctgaacccaggaggcggagcttgcagtgagctgagatagtgccactgcactccggcctggtgaaagagcgagactcagtctcaaaaaaaaaaaaaaaaggaagttcttagtgtgtaattgaccatcagggataaatgggcttcaaaagtgttaattgtctccttacttacagtgagtttctagagatagccctgtctttcagaaattctctgacatctgcttgcgcaatgttataaccactttcccacactactcccctccagaaatctcattgatatgtggcgaggacacgccttagctatcaccccaatggatgcttctttcattgacccaaatccagaatgtaatggggaactgaatacaagttggatgtctccacccttggaaagcacatcttttgttcttactgaagtagtttaacaccaccagatgatcaagggatcagggtatctttctggtatctttttaatcactgaaggactttgacagcagtaatggtggcattgttgactcttaaatttctgaacgtttcacttaatggcaagtgaagagatatagaatcccccaaagagtgtcaagatgctaacttccaaccctatttttatgtactgaagaggcctcagtgtctcactgaactctaacctttttgtcagtgttcctcaacactggatgcgtattattacataacctgaggagttaaaaaatacaataaccagatgtccaattaaataaaattagaatctggaggaggtagaactcaagcatttacagttttgttttgttttttttttaagacagagtctcgctctgtccccaagtgcagtggcacaatctcggctcactgcaagctccgcttcgtgggttcacgccattctcctgcctcagtctcccgagtagctgggactacaggcgcccgccactacgcccggctaatttttttgtactttttagtagagacagggtttcactgtgttatacaggatggtctcgatctcccgacctcatgatccgcccgcctcggcctctcagagtgctgggattacaggcgtgagccaccacgcccggcaagcatttacagttttaaatctcccagtcagaataaattcttattgagggccatacctagcctgtcttcatcaaactcataggtgaatctttgtcaaacctataggagagagatgcaggccatagagatggtcttgctgaaggtcttatagctaaattagttcagatccaggaaccagattctggaactgattgcacctatattatgttgtgtgtcagacactcccaggacctgtttggtaataattaggacagctgacatacttgttgctaattttgagatctgggcaacaactgtgtaggctgttctttcaacctctttcttcttacttctttacttttccttcagagaggagaaagccacccctgtgctatagccaccgctccaattctgactctagctaggtcatgaaacagactgagctattattgcatcaacacataaatcctgtcatttgggtattattctttagagaactagagattacctagctgcaacctaagtttcctgaattagaatcatttgagcagcaccatcttaattggctcattaacatatttgtgaccaggcacagtggcgcatgcctgtaatcccagcactttgggaggccgaggcgggcggatctcttgaggtcaggagtttgagaccagcgtggccaacatggtgaaaccccatttctactaaaaatgtaaaaattagctgggcttggtggcgcgcgcctgtaatcccagctactcggaaggctgaggtgtgagaatcacttaaacccgggagatggaggttgcagtgagcagagattgcgccactgcactccagcctaggtgacaagaatgagactccgtcttaaaacaaaaacaacatatttgttcacttttgaaccctgtggtgtcttttaactttgttaagggcccttggttagcaaaattatgaaagtttaggaaatttggctattgagtatattaagtacaactacaaaatcctctgagttctccaggaagcctaaaccttgagcagtatcttattcaagtggagtatatatcttcaagaatacagatttttaaggtaagtagtttttcgtctttgcatctcctaagaccattgttaacaaccttgatattaaacgaagaagtgaatgtaaacctccttttgaacatattttttataaagaaatattttgttaattggagtaagtagtattgttatgaaatcactgtgtaattgttaattgtaaactgcaatgtctattttgtgttgtaacaatgttgccataaaatagctttgctaaatgtgaaatgactttaatcccttttgtcttcaatatacttcataaaggaggaaatgatgatttacacaatttgtcatgaagcttccgtgtttatgagaaattccaagaagtaagagccaagaggacagatattatcagaatatgggacataagaaattgcatatagtgtcaagggtttctatataacaacttaatttatttcccttgcatatatagtaggggttaacattttgctcaatgttaacgggggacataatggacataaaacattggatagctttttatttaaatgagctaaaggtgtgcgtatacacatgcacttataaaattaaagtcatatatgtatatacacaca

SEQ ID NO: 139201 - DNA, 4378 bp, Homo sapiens
  Payload ID: 7282
  Gene Symbol: GNA12
  Gene Name: guanine nucleotide binding protein (G protein) alpha 12
  Uniprot ID: Q03113
  ENST ID: ENST00000275364
  CDS Start-End: 164-1309
ggcgacgagtgcgggcctcggagcgactgcagcggcggcggcggacgcggcctgaggcgagcggcggggcgtggggcggtgcctcggcccgggctcgccctcgccggcgggagcgtccatggcccccgggcgccggcggggcgcggccgcggcctgaggggccatgtccggggtggtgcggaccctcagccgctgcctgctgccggccgaggccggcggggcccgcgagcgcagggcgggcagcggcgcgcgcgacgcggagcgcgaggcccggaggcgtagccgcgacatcgacgcgctgctggcccgcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataagatctgttcctcatagctatactgtgtacacataagacgcatatagggttttactgaaatctatttttaactcttatgttcgtagagaaattgtttcaaggattttgagtcataggtctgtaatttatagagatctctagaattcttattgtaattttcctacttctttgataaaagaaaaataagtcagattgttaactccaagattgaaaaaaaaaactcttgaaagaagattattagttgtaactaatttaggggttctgggcacagacatctaacctggtattgtaaggcagaggctcccattggaatggtagtggtccgggtcagttgttcatggtgtaagctttgcacagtgtattaacattgggagggtctggcttgaaaatttggccaccctcagcctctgaatgtttattaaaataaatttagtctttctttgcttaa

SEQ ID NO: 139202 - DNA, 3918 bp, Homo sapiens
  Payload ID: 7282
  Gene Symbol: GNA12
  Gene Name: guanine nucleotide binding protein (G protein) alpha 12
  Uniprot ID: Q03113
  ENST ID: ENST00000407904
  CDS Start-End: 330-1298
atttaagcagcctccttgactgtaggtccgctgactggcttcctccttgagagcacactcacagtgccggaccgcaggcacctcgccgatgttcctgtccacttgctttttgtattgctccttctccagtgagcttggaagcctcatgcgggcaaggccttgtctgtctggttctctgttgtgtcctcggagcctgccacagtggcggcgcttggtggctttgacaggggactggattgggtggaaggggcgagattagacctggatacagtgacgtccttgtcagccatgccgagtgcagagcgcctactgtattgtaggcatttgaaatgaaacggagaatgtttcccaggccgtgcctagcaaggatgcctggcagtcgtggttcgggaagcacaccagatggaaaccgaaagtgctgccgttttgagcacctactcattgcacaccctgggtccaggggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaat

SEQ ID NO: 139203 - DNA, 3785 bp, Homo sapiens
  Payload ID: 7282
  Gene Symbol: GNA12
  Gene Name: guanine nucleotide binding protein (G protein) alpha 12
  ENST ID: ENST00000407653
  CDS Start-End: 253-1170
aatgcttctgagaagagagaggaagatgacttcagaggctgcttgtggtctctcactcaaggctggtagggagccccggtctgcgtcctggaggaacggcacgctgagtcctgggccagtggccggcggggctgttggcgaccacagtagcacacaagggctctttctgaggagcaggagaccctggcacgggccccacgggagtgtctggggcgtccccgcctgtggcctcttctccccgccgcagcaccaatggctccacgagcagggctcggagctggccctctcctgcttcggagccgcgctgactgggtgtgtggcggatgggaggccgccctgagtgctcctcctcccttttgtacagcctgggtggaaaggacgggcctggtgcacttcctgcgggagggaggacatggggcctgcttccctctggcgctcctccacccgggcagcgtggtttctttccaaatgatttatcctctcatcgtcctgccgctctgtgcttcatggcattggggtcttatccggaaggggattgtccttttttggggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctc

SEQ ID NO: 139204 - DNA, 559 bp, Homo sapiens
  Payload ID: 7282
  Gene Symbol: GNA12
  Gene Name: guanine nucleotide binding protein (G protein) alpha 12
  ENST ID: ENST00000447791
  CDS Start-End: 329-559
tttaagcagcctccttgactgtaggtccgctgactggcttcctccttgagagcacactcacagtgccggaccgcaggcacctcgccgatgttcctgtccacttgctttttgtattgctccttctccagtgagcttggaagcctcatgcgggcaaggccttgtctgtctggttctctgttgtgtcctcggagcctgccacagtggcggcgcttggtggctttgacaggggactggattgggtggaaggggcgagattagacctggatacagtgacgtccttgtcagccatgccgagtgcagagcgcctactgtattgtaggcatttgaaatgaaacggagaatgtttcccaggccgtgcctagcaaggatgcctggcagtcgtggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggc

SEQ ID NO: 139205 - DNA, 4147 bp, Homo sapiens
  Payload ID: 7283
  Gene Symbol: GNA11
  Gene Name: guanine nucleotide binding protein (G protein), alpha 11 (Gq class)
  Uniprot ID: P29992
  ENST ID: ENST00000078429
  CDS Start-End: 243-1322
gctgcggcggcggcgcgggctgagtgcggccgcgcgggagtccgcggctggcgcggcccgagcggggacccggcggctcgccaggcggcggccgaggcggggcgggccggcccggggccgagggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttctaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggataccccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcctagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgctg

SEQ ID NO: 139206 - DNA, 733 bp, Homo sapiens
  Payload ID: 7283
  Gene Symbol: GNA11
  Gene Name: guanine nucleotide binding protein (G protein), alpha 11 (Gq class)
  ENST ID: ENST00000587636
  CDS Start-End: 1-710
agctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctgttatcaggggatgtacatctctccctccgtacacttcgcgcaccttctcaccttttgtcaacggcaaaggcagcctttttctggccttgacttatggctcgcttttttctaaa

SEQ ID NO: 139207 - DNA, 295 bp, Homo sapiens
  Payload ID: 7283
  Gene Symbol: GNA11
  Gene Name: guanine nucleotide binding protein (G protein), alpha 11 (Gq class)
  ENST ID: ENST00000588401
  CDS Start-End: 1-217
cctgaccgacgttgaccgcatcgccaccttgggctacctgcccacccagcaggacgtgctgcgggtccgcgtgcccaccaccggcatcatcgagtaccctttcgacctggagaacatcatcttccgctgggcgtggttgtgtgcacctgtggtcccagctactcaggaggctgaggcaggaggatcgctcaagcccaggaggttgaggctgaagtgagccatgatggcaccactggactccagcctgggcgacagagggagaccctgtttcgtcttattaaacaaaagaaagccc

SEQ ID NO: 139208 - DNA, 4922 bp, Homo sapiens
  Payload ID: 7284
  Gene Symbol: GNA13
  Gene Name: guanine nucleotide binding protein (G protein), alpha 13
  Uniprot ID: Q14344
  ENST ID: ENST00000439174
  CDS Start-End: 247-1380
gctccggggccaccgcccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttacactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtca

SEQ ID NO: 139209 - DNA, 1502 bp, Homo sapiens
  Payload ID: 7284
  Gene Symbol: GNA13
  Gene Name: guanine nucleotide binding protein (G protein), alpha 13
  Uniprot ID: Q14344
  ENST ID: ENST00000541118
  CDS Start-End: 185-1033
aataagggaactttttgcccgagacttcttgtcaagggcgtagggtgacagcctccttttgggcgagaatatgaaacttgaggagtgtcaggttgactgtactggaatcaggagagagtggacccatacagttagcatgaaaatgtagcatctgtgctttttcgccccagtgtcacggtcaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaa

SEQ ID NO: 139210 - DNA, 2482 bp, Homo sapiens
  Payload ID: 7285
  Gene Symbol: GNA14
  Gene Name: guanine nucleotide binding protein (G protein), alpha 14
  Uniprot ID: O95837
  ENST ID: ENST00000341700
  CDS Start-End: 515-1582
ctgcggtcactgctgaggttttcagaactttccaggcaaaggccagccaggtcctttgcctccaacccactccgcgcctacctcccgcctggggacacccctaggcccaggagatcctactctcccccgagcaccgacgttccaactcgtctgcgcccccgactgctgtccggctcctgtgccaaggggcgcgcgcatcttcccggggccagcaacgctcccaacttctcgactcgccctcctcctccccagagcgagagtggggcgggctgagcccggatccggggtgcactcgagcgttcccagcgctcggcattcaccccgcctcagagccgactttcgaagggggattgagcctcggaggtccaggcgtcttactccaaagctcaagtcggcccccgtcttttctttccacacccctgtgcccgtcgcatgctggccgggtgagcggccgggccgaggattcgggtgcccggggccgcgtcgccccgtcgggtactgagctgagcgcaccatggccggctgctgctgcctgtccgcggaggagaaggagtcgcagcgcatcagcgcggagatcgagcgacagcttcgtcgggacaagaaggacgcgcgccgtgagcttaagctgctgctgctgggaactggtgaaagtgggaaaagcacctttatcaagcagatgagaattatccatgggtctggttacagcgacgaagacagaaaggggttcacgaagctggtttaccaaaacatattcaccgccatgcaagccatgatcagagcgatggacacgctaaggatacagtatgtgtgtgaacagaataaggaaaatgcccagataatcagagaagtggaagtggacaaggtctccatgctctccagggagcaggtggaggccatcaagcagctctggcaagatccaggcatccaggagtgttacgacaggaggagggagtaccagctgtcggactctgccaaatattacctgactgacattgaccgcatcgccacaccatcattcgtgcctacccaacaagatgtgcttcgcgtccgagtgcccaccaccggcatcattgagtatccatttgacttggaaaacatcatctttcggatggtggatgttggtggccaacgatcggaaagacggaagtggattcactgctttgagagtgtcacctccattattttcttggttgctctgagtgaatatgaccaggtcctggctgagtgtgacaacgagaatcgcatggaagagagcaaagccttatttaaaaccatcatcacctacccctggtttctgaattcgtctgtgattttattcttgaacaagaaggatcttttggaagagaaaatcatgtactctcatctaattagctatttcccagaatacacaggaccgaaacaggatgtcagagctgccagagactttatcctgaagctttaccaagatcagaatcctgacaaagagaaagtcatctactctcacttcacatgtgctacagatacagacaatattcgctttgtgtttgctgctgtcaaagacacaattctacagctaaacctaagggaattcaaccttgtctaaaagctgctgcccactcctcccctataacagaagatgtgatttgcaaactccttgttttatttgcaagtgcttctgacatcaccagagccagccccatgccaggaactaaggatgtcatgtagatcgtggggacagagatgggtgatggaacttggaagatatttgagtttaccaacatactttaaaagtccttacatcccaaattgtgtttataattattttcttgacttttggctataagattttgtgtaatttttgaatttggtgttttctagaatttttaaaagccactttgatttagttttaaatatgtttaaaaatagcgattaaaattatgtaagcaaggagcctgttagtttatagatcatgccttcaaacctctagagttaatttgggtgacttttttaaaaataagaatgttaatgggtttgaagctttttattaaaccttgtaatttagagacatttttaattgtgtttctcacctcatgctgaagggtgactcctttaacatgccaccaaagattttttttaaacacttggttctttttgtgtgttaactttctaagccaaattaatggatatataagtatatctaatttagctttgccacagtttgatcaccaagaagccaaagctgacatagagtaaatgggctctagatagcatatatgttttattggtgaaaaatgtgtgtgtgtgcacgtgtgtgtgtgtgtacatttttacccccaatgtatatgaccagatcttaaaaatgtatgaaatggctagaagtccacattgtttgacaaatgttacgtaaccctgccaaagttctgatggccaccacagatttgctgtttgaattatgtatgctgtgcctttctgaggaggctaagaatataccattctgctatta

SEQ ID NO: 139211 - DNA, 2133 bp, Homo sapiens
  Payload ID: 7286
  Gene Symbol: GNA15
  Gene Name: guanine nucleotide binding protein (G protein), alpha 15 (Gq class)
  Uniprot ID: P30679
  ENST ID: ENST00000262958
  CDS Start-End: 259-1383
ggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggatcgtggacgtcgggggccagaagtcagagcgtaagaaatggatccattgtttcgagaacgtgatcgccctcatctacctggcctcactgagtgaatacgaccagtgcctggaggagaacaaccaggagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggccctaagcaggatgctgaggcagccaagaggttcatcctggacatgtacacgaggatgtacaccgggtgcgtggacggccccgagggcagcaagaagggcgcacgatcccgacgcctcttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggacccctagtgtccctggtctatctctccagcctcggcccacacgcaagggagtcgggggacggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgaggacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatccccccatcccttgcaggctgggggctgggcatgctgcatcttaaccttttgtatttattccctcaccttctgcagggctccgtgcgggctgaaattaaagatttcttagaggctgcgtcgccagcgtcctgttta

SEQ ID NO: 139212 - DNA, 799 bp, Homo sapiens
  Payload ID: 7286
  Gene Symbol: GNA15
  Gene Name: guanine nucleotide binding protein (G protein), alpha 15 (Gq class)
  ENST ID: ENST00000592455
  CDS Start-End: 10-168
caccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttggtcccaggctcttgaagactccagcatcagtatcccggacccagggccggtttggcaggtgcgcgaactgggctgtcccagagggttccaggctcagaagagcctgaagtttcagcttgcacccagccccagaaaatctgtggctggccctgcaaggaccctgccagattttgtaccatctgtcagcaaggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcaga

SEQ ID NO: 139213 - DNA, 3281 bp, Homo sapiens
  Payload ID: 7287
  Gene Symbol: GNAO1
  Gene Name: guanine nucleotide binding protein (G protein), alpha activating activity polypeptide O
  Uniprot ID: P09471
  ENST ID: ENST00000262493
  CDS Start-End: 847-1911
actcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgta

SEQ ID NO: 139214 - DNA, 5574 bp, Homo sapiens
  Payload ID: 7287
  Gene Symbol: GNAO1
  Gene Name: guanine nucleotide binding protein (G protein), alpha activating activity polypeptide O
  Uniprot ID: P09471
  ENST ID: ENST00000262494
  CDS Start-End: 261-1325
agccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtccccaactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgctttccta

SEQ ID NO: 139215 - DNA, 847 bp, Homo sapiens
  Payload ID: 7287
  Gene Symbol: GNAO1
  Gene Name: guanine nucleotide binding protein (G protein), alpha activating activity polypeptide O
  ENST ID: ENST00000565363
  CDS Start-End: 462-847
tcgcatgccttagtccccccctccccctgttcccttaagctgacactcaccagtttttccccactgtctgtgtcccaacaggggctggagaatcaggaaaaagcaccattgtgaagcagatgaacccctcggggagtttaaataaggtgctgcggcacttgagttctgcaaaagacacctattcgctgaccagacaaagatgcttagccacaactcacaactctcagggtgcagttcgaagaggaggaagcagcatggcatataaagctcatgctcccttgaaggctggtgattgagacaagttatgtcttctagcatttgactccctcaaagagattgcaggacttccctctgattgcaggtggctcaatccactcagatcacctagaaacttgatagagatttagaatcttaaagaagacagaagcttagacagagcatgtagcccagcccatcaacagatgaagaagttgaatcctgcagggactacaaggaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccac

SEQ ID NO: 139216 - DNA, 440 bp, Homo sapiens
  Payload ID: 7287
  Gene Symbol: GNAO1
  Gene Name: guanine nucleotide binding protein (G protein), alpha activating activity polypeptide O
  ENST ID: ENST00000564727
  CDS Start-End: 1-285
atcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaacctt

SEQ ID NO: 139217 - DNA, 543 bp, Homo sapiens
  Payload ID: 7287
  Gene Symbol: GNAO1
  Gene Name: guanine nucleotide binding protein (G protein), alpha activating activity polypeptide O
  ENST ID: ENST00000563440
  CDS Start-End: 294-543
atattcccaccacagctggtttcaagctacccatctggccagtgagtgatgcaacgttagctcttgtgagccagcacaactcactccagcacaccactgggtcaggccatggaagatagaagcaagaaggactgaagagcattccatggctttgctctgagcacctgggtagatggggatgccgtctactgaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagccca

SEQ ID NO: 139218 - DNA, 492 bp, Homo sapiens
  Payload ID: 7287
  Gene Symbol: GNAO1
  Gene Name: guanine nucleotide binding protein (G protein), alpha activating activity polypeptide O
  ENST ID: ENST00000562316
  CDS Start-End: 161-492
tttccacttgcaggctcgcttcttgccctatccactcggcagttcctggtgatcccacaggatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcag

SEQ ID NO: 139219 - DNA, 500 bp, Homo sapiens
  Payload ID: 7287
  Gene Symbol: GNAO1
  Gene Name: guanine nucleotide binding protein (G protein), alpha activating activity polypeptide O
  ENST ID: ENST00000570235
  CDS Start-End: 262-426
gagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagtaagtccctgtggcattgggattcgtacttttattaagaataatttttaaatcgtttttattacattgcttactcca

SEQ ID NO: 139220 - DNA, 1722 bp, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENST ID: ENST00000269162
  CDS Start-End: 302-1447
ggtgagcctcggagggatcctcctccctgctagaatatgcatgatcctccgcgagtcttcgcccgccaggagcagggacgcgtccgagccaacacggggcgcgcgcccagacgcactttcccggctcggggtgcaagagagccaggcggccgcggcgcagcggaggggctgcgggcccggaacccaggccggtcagcgtcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattatt

SEQ ID NO: 139221 - DNA, 6535 bp, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENST ID: ENST00000334049
  CDS Start-End: 609-1985
tcctacacccagctttccgtcctcggttactatcgcccaagatcaaagccaccctggttttctgattgccgcaactgcggctccaggtgctgagtgcacagccactgcggcactgtccgcagctgcgcgccgggctcagacggcattatttacggtacagaatactcgcccgcgcgacggtatttacggtaacggggaccagcctgggcggcagtatttacggtaacgaaagccagctgtatttacggtagcgagggctggaccggcggcggcatttacggtaacgggggccgggctcgcggaggcccgtcggttcggtccgctctgggcgttagcaagtgatctccagccaaggcggccgccaccccttgcacacagcagaaaatgcaaaatgaccctctggggcagtgaggggctgtggccctcggccccggcctgccgcacccccttcccgcagctggcggccggcagcgccgaacagggtccgggtgcagccccctcccgcccctccgctgaggcgccggcctgaactgggcgcgggaaccaggccgccctcggcgcccagcctgccctagtcccgcgcgccgcccccgctgtgccgcgcccacatgggtctgtgctacagtctgcggccgctgcttttcgggggcccaggggacgacccctgcgcggcctcggagccgccggtggaggacgcgcagcccgccccggccccggccctggccccagtccgggcggccgcaagggacacggcccggaccctgctccctcggggcggcgaagggagcccggcatgcgctcggcccaaagcagacaagccgaaggagaagcggcagcgcaccgagcagctgagtgccgaggagcgcgaggcggccaaggagcgcgaggcggtcaaggaggcgaggaaagtgagccggggcatcgaccgcatgctgcgcgaccagaagcgcgacctgcagcagacgcaccggctcctgctgctcggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttcaccatggctatctatacctgtacatgaaatgtgtttgtattgtgctgaagagcttaatgtcaacattacctgctgcttactctgaaaaaaggaatgaatggtagctgtagaatttaggatattttatcaggttggcactttataaaatactccctgatttaaaaaattgtaagttatacacgttaatcatccacattctatcgacaatgtaccaacatcacaagctgttgcaaccacctgctgttacttctctgagctgtaaaaacctgaactcaattcaggggtacaaattgcaatctaatcttttcagggaaccagggatttttttctctctctctagacaatatgtttcctcattagtctgctaatgaaacacttcttcaagttccccaagtgggaacaggtccatcattcccttagtcaaaactttggacacaggctacgtcatacaagtaagcaaacagtaagagaaaaacaaaatgtggccaggcgcggtggctcacgcctgtaatcccagcactttgggaggccgaggcaggcggatcacgaggccaggagatcaagaccatcctggctaacatggcgaaaccctgtctctaccaaaaatacaaaaattagccaggcgtggtggcgggcacctgtaatctcagctactcgagaggctgaggcaggagaatctcttgaacctgggaggtggagattgcagtgagccgaggtcgtgccatcgcactccagcctggacatcaaagtgagactcaggccaaaaaaaaaaaaaaaaaaaaccttgacgtgtcaatgtttgtgtctggcctaggagaatgaggatgacagcttcacttgccttttgaagaagaaacattacaaaaccttaatctgaagtataaagtcaaaagatacggctctttctcacacttgcaagacttacaaatacagcctcaaacattatgacacaccaacaatatctagaaagtaagaactggtgtagcaatgatgcttcatattctagctgtagccacagagttgagggtagtttttgtaggtctaaaataataatctataaagatgtccaaagttaaattttcaacaatacaaatctagagaagtgacagcctacattacttcattattactcttcttttagtctttagtctttaatattttaaagtttactctataaatcagcattttgtaatcctttataaactcatccagatttaaatgctactttttcatgaagaaaggataactttatagacagtcagtgcaacacacacattttatctcatcaccgtcttactgcctccccatccactgtctcataaagccctcagctgaactaagataaataatacaatggaaattattttcagttccccttgcactgtcaaagtaaaacaagaaaactgaaaagctgcacccccagcaagaaagggaagtatgctgttgtatgcatcattactcaacaattaccctctaactaaacatcctgtttaagagtttaattcaaacaacagccagactgttaagaaaaaaaacaaaaagaataacttttatctggcttacaattattaaagcatttattttcaggtaccaaaagccatatcccattccactttttaagtttcttttgatcactgacaggcattaacagatgtagcaacgtggtctcctatagagaaaattacacttatctaaaaatctgattccattaattgatcaagtataaaaatctacgaaaacaatatgttctgcacatcacatctgtacttttttttttttaaatatattttttgagacggagtctcactctgttgcccaggctggagtgcagtggcatgatcttggctcactgcaacctccgcctcccgggctcaagggattctcctgcctcagcctcagctggtattataggcacttgctaccatgcttggctaatttttgtatttctagcggagacgaggtttcaccatgttggccaggctggtcttgaactcctgacctcaagtgatccacccgcctcagcctcccaaagtgctgggattacaggtgtgagccactgtgcccggccacatctgtacttttaagggtacagctttacagtacataggaatttgagaaccacttcacaggaagagggaaacagcccaatatttatttatgtatacacataatcccaagtgtgtgctggggccaccaggcccttcctgggggaacaaggactgtcgtgcatgtgagtgacgacattaatagcatttacatactgtacagatgcaacctttgatgatacatatatttgataaaaatgagaaaacagatttgttgtagagtacctgtccacttttatagcatgagaacagtacaatcaactatttattttgcagttactcatttcagtgattgagaatttctgtgctgtgcagagagacggcctgtaattggtctcatcatccacttgattctaacatgatctctgcccaaagttccatttcttgggctttgatatttataatggcgcctgctcttcatcttgtcttacgctttccgagcaagttcaaaccagaaagaaaaggtgaggctagaagcccaaagtgagtgagtgtgaggaccacaaggaagcccaccactccacagtagatgatcaaaaccacatcctcacgtgggaggtagcacttggagagggtgtagtctgtgggcgtgatgctaccctggaaaggagaagggaaagttatgctgagagcaccaggcacacgttgaacaccgcagtcttagaaacagcagagggaagactgccttctcaggtccccctcaggtgaggcagggaacgggccctcctcacctgagaccaagggggcccagccttctccctgcacagctcacccccgaccagcccaggctccagcaggagagacaagtaaggcccaagtgtgcctgagtggaaaatgtctgggacactgacctgtcaaaactggcccctggctcactgggttcccatcaaatatagtgggggatccataacagagattcagagaggcaccgtggagttccagggtcatcggtcagcgaggaacaaggagggaaaggtgtcttcctgccccttgatgctcaactaagcatctgttccctagaaatacatgtgtccaggtcgtctccatgggcttttctttgcagatacttttatgtggaacaacagtggcaaatgttttcatttactttgaatttgaaaatgttagggtttcctccacctttttatgaagtaaaagaacctgtcgtaccagcatcatgagctggatgcaggagcccatggctgaaaggagttaaaacgcccagtggtcattaagtgaaacatcttttatcaacctgcaaaagctgcagcgttctctgccaggtcaaatgggcatgtttagaaaataagagaagatggctgagtatagctaatgaataaatggttgtttctttagaaaattaaacacacacagagtgtaagaggagaggatacggccctccctgaaggataaagtccacctggacggtgccctgccctcgcttctcacattaactgcccaggaatgtcatgctgattggttcccggaagggtgtttggcaaggggcagtgtatggagctacgtgtagaaggagagaaatttgtgtgtggcttttgtaaattttgaccgattgcagcaattaaatagttgattactgtgttgatttaaatacttatgaaagctttcagacaaaaataaactttcacgttaccatgatgaaa

SEQ ID NO: 139222 - DNA, 2255 bp, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENST ID: ENST00000423027
  CDS Start-End: 322-1467
gtctccagcggagaccggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttca

SEQ ID NO: 139223 - DNA, 1285 bp, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENST ID: ENST00000535121
  CDS Start-End: 140-1285
agtctagaagctgagcagaacaaaggcggtgtgactgcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtga

SEQ ID NO: 139224 - DNA, 451 bp, Homo sapiens
  Payload ID: 7288
  Gene Symbol: GNAL
  Gene Name: guanine nucleotide binding protein (G protein), alpha activating activity polypeptide, olfactory type
  ENST ID: ENST00000586926
  CDS Start-End: 1-164
gaacaaacaagatatgctggcagaaaaagtcttggcagggaaatcaaaaattgaagactatttcccagaatatgcaaattatactgttcctgaagacggagcaccaaggagaagcaccaccactggctgacagccaaggccacctgcccagccgcgggtgctgaagggcttccgtccaggggctgaggggaccctggcttgctgcctcggtgccaggcccagtgactgctcttcacccagcagcatgcgtcatctccatctgtgccctgcctctcccaagagactcacccatccctgagcatctgcagcacctgctggaagcctgggaccaccatcaactccaacgtcaactctcacttagcaattaaaaggaactaacagttggtccatgtgacggcatgggttaaactcacagtaattgtgctgacagaaagaatcaaagcaaaaacta

SEQ ID NO: 139225 - DNA, 623 bp, Homo sapiens
  Payload ID: 7288
  Gene Symbol: GNAL
  Gene Name: guanine nucleotide binding protein (G protein), alpha activating activity polypeptide, olfactory type
  ENST ID: ENST00000585642
  CDS Start-End: 86-623
agcgatatccggacacagatcacagcgttctttctgtttgtttgcaggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctaca

SEQ ID NO: 139226 - DNA, 585 bp, Homo sapiens
  Payload ID: 7288
  Gene Symbol: GNAL
  Gene Name: guanine nucleotide binding protein (G protein), alpha activating activity polypeptide, olfactory type
  ENST ID: ENST00000590228
  CDS Start-End: 151-585
ggaaatttaaaatcccactcaattgattggaatcagtgctaagagtaaattaagctaataacaactctctttcaatacagggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaac

SEQ ID NO: 139227 - DNA, 1038 bp, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENST ID: ENST00000602628
  CDS Start-End: 477-1001
aaaagagactgaaggggagactggacagactgcaaagggctggaggccacattaaaagtgtggactttaccccatgggaaggaggaagcgcaggagtcatgagaaatgatggttcaggcagagattagagcataaagcagggaggtggggaaagccaagaggaacacgctcttggatgacgagtcaccatgaatcactgatcacctgggacatggttcagctgcacatgctgacgcagtgggtctgccagtgacgccgatatgctgcgagtctgggaaccccttttaaggagcagggaatcttaactctggctgtgcattacaactgcctggtactttgtcaccaccttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccg

SEQ ID NO: 139228 - DNA, 3347 bp, Homo sapiens
  Payload ID: 7289
  Gene Symbol: GNAI1
  Gene Name: guanine nucleotide binding protein (G protein), alpha inhibiting activity polypeptide 1
  Uniprot ID: P63096
  ENST ID: ENST00000351004
  CDS Start-End: 374-1438
ggaggggcgggcaggggcggggccgcggcggcgcgcggaggccgagctcggctgggcttggcgaggctgcggcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaattttacattagattccacgttagatttggtttgaaaaactaaaatttcagatttctgaggatatactgtcttagacttattgtacacacttagtttttattcacttgttttcactctgaattttaatatttggctgatatgaatgcattgcctcaaaggtgatgtcatcttaatttttattcactttaaataactacatttttgtttataactaagtttggagggatcctaagagcatttttgtgggtaaaaaaaaaacctgtggacataatgaattttgagacattgattggtgaggcttttatttcccttgaggagtctcttgtacctagcatacatgatagctccttgttgggaagataacaagaaggatctttgaatactctattgctgatataatgcaagatttaaatttatacatataactaatttcaaatgtaattatcacactatgttaaaattacttttttcccttagataattcaaatttctccacttgcttgagattatatcatttctttttcaattatactattatttctgagaatgaaatggacgattacacttagaaaatgagtaatagtgtttaataagtcagtgattatatgtgtgctcaaataagtgttatgtatcagctagatactgagctttgatagaataattttcttttgattattcatgatgtgtcatctctgaccttgtttcagcaaagtaaacagcactccccaccccaccctcctttttttactcatcttggaaaaggttagtctttcagtacacgttgctggtaagtagtttccaagttacgtgttgtcactgggttgaagtatatttgtgtgtgtgtgtgtgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattt

SEQ ID NO: 139229 - DNA, 571 bp, Homo sapiens
  Payload ID: 7289
  Gene Symbol: GNAI1
  Gene Name: guanine nucleotide binding protein (G protein), alpha inhibiting activity polypeptide 1
  ENST ID: ENST00000447650
  CDS Start-End: 447-571
agtgtgagggtattttgggaaaatttcttacatatcaaaccacaagtaaaatttagggagttttatcctcagattttcaaatagggcatttaactatgacctcttttcagatgcctctgatgatttgggtgtgtgtgtgtgtgtgtgtctttgtgtgtgtgtgtgtgtgtgtgtgtgtgtgtctttgtgtgtctggagagggaaagaggtaaagggagagatgaggcccagaagttgaccatcagttgtatcagtcagaaatagcttaaataaattcaagtacatttctggttggttgattttgtgtatagcacaagctagcttctgagaattcaaatacaaacatgtgcaaagtgagaggcagcaggaatcacatgcagagtgggtaaggagaggttgacaaaggaggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagataga

SEQ ID NO: 139230 - DNA, 607 bp, Homo sapiens
  Payload ID: 7289
  Gene Symbol: GNAI1
  Gene Name: guanine nucleotide binding protein (G protein), alpha inhibiting activity polypeptide 1
  ENST ID: ENST00000418742
  CDS Start-End: 174-607
ccgggtcggggcccgggggtcggcgggggaccgggtgcggcgctgcgcggccctcggcgtttggaaacccggagggaagggggaggaagcgcccgaggaggcttctgagcgggagctgggtccggcggtgcggaggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaa

SEQ ID NO: 139231 - DNA, 539 bp, Homo sapiens
  Payload ID: 7289
  Gene Symbol: GNAI1
  Gene Name: guanine nucleotide binding protein (G protein), alpha inhibiting activity polypeptide 1
  ENST ID: ENST00000442586
  CDS Start-End: 472-539
gttacagctggaaggatggggagatagcaccatagatccactcctcattttatgggcaaagaagctaaggcctgtaaaaatggcatgcccaatggttacgaggaaatccttcaaaatgcgttcttgtgaaaaacgtgagagtgcaaggaaagagggagggataggaagaaggaaagagaagcaaaagttccctgtttctcacggccctgaaaccagccgacagggatttgcattttgaaaaaccttgcgtggctgccggcgctgggcatgctcaaacgcccagaactggcttttttcggcaactttggcagctctcccacccccacccgaaggggcaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacct

SEQ ID NO: 139232 - DNA, 1633 bp, Homo sapiens
  Payload ID: 7289
  Gene Symbol: GNAI1
  Gene Name: guanine nucleotide binding protein (G protein), alpha inhibiting activity polypeptide 1
  Uniprot ID: P63096
  ENST ID: ENST00000457358
  CDS Start-End: 357-1265
gaaatcagtgcaccttttgtggggcctctgagatggggctgaagcgtctttcctgttaacttcctatggcgactccttaagtggtcaaggagcgctgattacattccccctgcgctgagaaaaggctgcgctggatgcttgatttttcttgctgtgggggcatggaagccacccaagtggggttgggaagctttgctttagtagtaggcaaggcagatactcgagtggtgaaaactgctgtgaaagagcgagagggtcacgccagacaacagggttctgtctccgctgccaccgtttctgatgaatgagatttgccaggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaat

SEQ ID NO: 139233 - DNA, 2169 bp, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENST ID: ENST00000266027
  CDS Start-End: 262-1173
gcggtgctgggcctggtgggcatggggtcaagtcatgcctcctctggtgctcgtgaggccctggctaggcagctgccctctgcccccaaaatgaactctcctgaaaggactcctggattcctgagtatgaagaaactgagatgcccacgatgtacctcactgatgactgtgactggctcctggcccactctggacctcagctgactcagctgcaaagcaaggggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgt

SEQ ID NO: 139234 - DNA, 2464 bp, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENST ID: ENST00000313601
  CDS Start-End: 385-1452
agtgccgggtcccggggtttggaaccacccctattgccttttctccgcgtggccccgcctgcagcccaggcccgagcctgggctgcgcctaacttcccccttcgctccgccctcgagccaatcaacagcctctaatctcctctggccccgcctgcaagcccgccccggcccagtcacaggcttggttcgcccaggccccacccccggcccgccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaata

SEQ ID NO: 139235 - DNA, 2168 bp, Homo sapiens
  Payload ID: 7290
  Gene Symbol: GNAI2
  Gene Name: guanine nucleotide binding protein (G protein), alpha inhibiting activity polypeptide 2
  ENST ID: ENST00000441156
  CDS Start-End: 133-561
agtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaat

SEQ ID NO: 139236 - DNA, 1663 bp, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENST ID: ENST00000440628
  CDS Start-End: 344-1255
tgtgagtgcggcagcggcagtgagtgggtgtcgacgcggcggaatgcccgtcgctgctgctgctgctgcccgacgggcctggggagggcacttccggtaccgctgcctcccagtgcccagccaggagtctctagacagcctctccccaggcgattgcagttactgtggtggccgaggaaatgcaagactggaccatagagctgggggaacgcagggcttctggctagttttgtgtcccgacaccagaagggtcccccatcccaccaggcctgctccttggagcccagctcaccttttgggctaaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtt

SEQ ID NO: 139237 - DNA, 2086 bp, Homo sapiens
  Payload ID: 7290
  Gene Symbol: GNAI2
  Gene Name: guanine nucleotide binding protein (G protein), alpha inhibiting activity polypeptide 2
  ENST ID: ENST00000446079
  CDS Start-End: 388-828
ccgagtagctgggactacaggcgcccgctaccgcgcccggctaattttttgtatttttaatagagacggggtttcaccgtgttagccaggatggtctcgatctcctgacctcgtgatccgcccgccttggcctcccagagtgctgggatgacaggcgtgagcctctgagagcaaattttacccagttcctctctatcctcccgatgactctgaaatcaaactcagcaagtcatccgagcccccacggcgcagcggccctaggctggcatgggcgatgcggagctactccgccctcaggaagcaggcgaggtgcccagcgggagaatcacccacatcaccgtctaatctctgctgtgaagtggaagcgcgagaaggagggagcgtctcatgacggagggtgtgaagacgctaggctggacgaagcagaaaggcgggtgtcactggggacgttctgagggcccctggttgctaaggctcagtgtggggagaagaagggctgctaccctgttggatggagtatgcagggcatcttcctgccagctctgcccagggcaccatattggcatgcaccagctgcacaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaagg

SEQ ID NO: 139238 - DNA, 1486 bp, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENST ID: ENST00000451956
  CDS Start-End: 176-1132
agtagctctgactcctgtcccaggttatgctgagtcccagcagggaaccaccacagctctgaatcagcctgttagccgctgtccattgctcttcatctgctctttatctgaaaatcttcagaagctttccttcaaatgagatgaccacagcagtcttctctgcaggttgcaggaaatgagaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcct

SEQ ID NO: 139239 - DNA, 2407 bp, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENST ID: ENST00000422163
  CDS Start-End: 833-1852
acacgttgcccagccgtgtggctgggatggtcggtacccatggccgtgcggtcgagccttgatgctccaggacagtcctggaaggcttcctggcagatccgtgggaagaaagccgacagaagggcgggaggcgggaggggaaaggtcccccgggatgggtagggcctcaacgctgggcatcggcgcaggtgtgtactgcagggagccagccagaccccccacggactgcctgaccttgggggaagcccggagtagaggaagaggccggacccccagacccgccattgactatgtccgccattgactatgtgttctgagagaaatttttttttttttttttgagactgagtctcactctttcgcccaggccggagtgcagtggcgcgatctcggctcactgcaagctccgcctcccgggttcacgccattctcctgcctcagcctcccgagtagctgggactacaggcgcccgctaccgcgcccggctaattttttgtatttttaatagagacggggtttcaccgtgttagccaggatggtctcgatctcctgacctcgtgatccgcccgccttggcctcccagagtgctgggatgacaggcgtgagcctctgagagcaaattttacccagttcctctctatcctcccgatgactctgaaatcaaactcagcaagtcatccgagcccccacggcgcagcggccctaggctggcatgggcgatgcggagctactccgccctcaggaagcaggcgaggtgcccagcgggagaatcacccacatcaccgtctaatctctgctgtgaagtggaagcgcgagaaggagggagcgtctcatgacggagggtgtgaagacgctaggctggacgaagcagaaaggcgggtgtcactggggacgttctgagggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaagg

SEQ ID NO: 139240 - DNA, 27174 bp, Homo sapiens
  Payload ID: 7291
  Gene Symbol: GNAI3
  Gene Name: guanine nucleotide binding protein (G protein), alpha inhibiting activity polypeptide 3
  Uniprot ID: P08754
  ENST ID: ENST00000369851
  CDS Start-End: 111-1175
agctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatcctggaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcaggtccccatttttctgcctctgtaccatttacatttgctctctgtttgttaacatgaagatcactcttatttcaccatcccaaataacttatctaaatgcacattccttgaggacacagggagacaatttaagtcagtagtttttaatatgacttaagtaaaaatcacttggacccatctaagggattgacttttggctggtgggctggcaatcgattttttttttttttttttttttttgagacggagtctcgctctgtcgcccaggctggagtgcagtggcgcgatctcggcttattgcaagctctgcctcccgggttcatgctattctcctgctgggactaccaggttcctgccaccacgcccagctaatttttttgtatgtcttagtagagacggggtttaaccgtgttagccaggatggtcttgatcccctgacctcgtgatctgcctgcctcagcctcccaaagtgctgggattacaggcgtgagccaccgcacctggctggcaatttataatttttaaaaggtgattctgattaccagccaggcttgcaaatcactggtttgtattgaaataaaagatattttcttgtagcagggctaaaatgtgggatgaaacattaaatctactagcctgaaaaaaaactttggcatttgtaatcaaagaagctgaaagttgccttgtgtgtttcctctgaagaatgctggagatttgtgatggataatgtttcagaattcaggtgcctatgctttggaccatcaaagaagccattagtctctgtgtaaagaagaagtattcttaatggacagtcccccctaaccttataaattcagctttgcaacagatttcacctcctagcatgaaaattccaaaaactttaacaattactcataagtggatcttgagatgacattttcatcttggacagtttgaattctaaatctctagttcacagtgaatcgttttttaaatttttactgatggatcgttatttttcacaaggtactacattcttacaatgtaagactagatggaccaaaattttaaaaaaaacttcttgccttgtttttttaattttcatatatattctatttgttgtatatacacattagactattttaaaataacagctggtttttgtaattcattcattcaccctatattcttatattctgctcattattctctcatttatagctgtgacattctttggacattacttgcctggcctgattagttacttaatataatttattcatttgcttagcatgtgtgacatagttctggaatttcctgttgcagaactccttgctgtattgcagtcatatataaggtaaagtcagtctcttgttcctattaaaaagctaccattgattattttccctttttacatgttcaaaaaaaaaaaaataagcaaccctctactcatttgtataaacctaaaacgtcactgttttccttgagcgttagtacttgtgggttctttccttttcatgtgtaatactgattttaagagcaatgatcttagtttgccagtgccaggtaattattgtgttctactttaggcttcgtagtgcaaatcagggatctgacctggatcagcctcagctctttacatagctttatgatcatcatattttgttgtattgctcccaacaagcacaagagaaaaaggcaggcttcctagagacctcaagttgaaagttgattttgctgacaactatcagggagtaaaagaaagcctttttcaggcactggagaactaactttaatgatgatcaaggtctttatgcctttatcttttagtttttaagatcatttctctccctcctttccccccagttttctcaacatttatgagttagttctgctgagaacaacatacttcagaacatgtcaggatagggcagttttttcttgtttttcttttttctttttttgagacagtcttgctctgttgcccaggctggagtacagtggcacgatctctgctcactgcaacctttgcctcttaggttcaagcgattcttgtgcctcagcctcccaagtagctgtgattacaggcatgtgccaccacatctggctaacttttgtatttctagtagagacagggtttcaccatgttagccaggctggtctcaaactcctgacctcaagtgatttgcctgccttggcctcccaaagtgctgagattacagatgtgaaccactccacccactcagggcagttttttttctgataccatatcaggcctaggcctgggctgactcaaatcttctcaggaataagaggtaagaaggaatgttaaacagcagtagttacctggggtacatggttaatttgatttagcagattctttggctaaaccctagtaaattaaaatgtctgagccaggtcatgggaatatacatgtttttaatacattccttaggtgattttgatgtagccaatctgggccaacatttggggacaactgagtaggacctaatacaggttgaatagcccttatccaaatctcttgggaccagaagtgtttgagagttcagatttttgtgaggttttgaaatatttgcattatatacttattggttcgggattccaaatccaaaaatctgaaatccaaaatgccccagtgtgtgcttcctttgagtgttatgttgttacccaaaaagcttttgattttggagcattttagattttggattttcagatttgaaatgctcaatctatattaaagatcaacacaggctgagcacagtggctcatgtctgtaatcccagcactttgggaggccgaggtaagcagatcacttgaggtcaggagtttgagaccagcttggccaacatggtgaaaccccgtctttactaaaaatacaaaaattagccaggcatggtggtggatgcctgtaatcctagctactcgggaggctgaggcaggagaatcgcttgaacctgggaggcagaggttgcagtgagccgagatcgcaccactgaattccagcctgggcgacagagtgagtctgttttttttttgtttttttttaaagtcaacacaaatattgaaaataagcaacttcagtgcacaaataagctcaaaatcactagtgagtgatctattttttgccaataagaagtaccatttgtacatgacttaaagtgccttccaccaagaaaattattgaaaactgttgggtcacataacattcctacactttggatacagagtatttagttttatacaaaattaagacaacaagaaacctaggatgtccaaacattcatttcatttattttactgcatttatttatgcagtgaaaattgaaagatacaccaaattaaagataaaaccctgtgacagataacagtatatgtaataacatgaatatttatttacacttggtagagaaagcaaagctagctagctctaaactagaatgaaagtcgttttgaaatgggtacgggggtatataaggggaatgattgagtcacatgtaaaagcctttgtatgcccagtgctagtgttttcctgaaatctagtgagaatcacaaggtaccagaaataatcaaataataaatattaatacactgctgggatagaagtatctcagtgtaccagcattcactaagctataaaatctgtgacagcaggaatattaaattatgaacaacctggtttatctgtctcctcttatcttttacctctccctacgcccaaaattctccttaggttatccagacatttttactaagatgcttatttatatgtaagagagatttccagtagatacaacaaaacacaagaaatcacctgttctgtttattcttgctcatgtaggataaaggtcctgagacctctcagaatcttacgaggttggagagttgtttggaatgctgggttctggtcttgtctctgcttccaaccagctatggaatcttgtgtattctttcagtcttaaatcactcatctgttatctaaagatggactaaattattccttcctgctgtgatattctgtggttctcatcagatagaaataacatatttgaaaatgctttgtaaatgttatgatactcaggattatactgcacagaaaaaaaaaaatcctaaggcagcaccaacaaaggtattcaacgtagtgggtggtcttttacagcattactttgcccatattcattttgaagacctgaaatgaagttgaactataaattgctctaaaattcgtgaagcagggtgaaaaggtctttgctttgttttacatttaaatccagctgtctattttctgcttatactagtgctttttcatggcaaaaagacagaaaagttcccttctgcagtctccagtgtcttctgacctcacagaaatgttttcatgcttttacctagcaggaccaccagaggctctgtcacacttgcagtccctggcccaacaccgaaatccttctggaatctgtgctctgggggctgtgccgggtagagagggcagtgggaggtaagagctcttcacccttcaccaccttctccacccagcatggccggcacactttggtctacggcacatctccaagtatagagtgggttttgaatgctgttatgtctcaccgtggggatgggaaggaatactctgttttggactatttggaggtacatgtgagtggattttattaccagagtaggaactgtttcaagttaatgtgtcttttatgttgcttttaagacaacttttgtgccgcttttatccattcttccttttatccacagaaatacaaatttctaattatagtatattttttctatttttaaaattgtgataaagcatatataacaaaatttgccatcttaagtgtacagttcagtggcattaagtacattcacactgttgcacagccatcaccaccatccatttccagaacttgttttcatcttcctgaactgaaactctgtacctgttaaacagtaactccccatgccccaccttctttcagcccctggtaaccagcattttcctttgtctctatgaatttgactattttagatacctcatataagtggaatcatagtatttgtccttttgtgtcaatcatattgtatttttgtctaaaaaaggaaaactatcagatttatgtgaaatgtaacgtaatttacatttgatttactgttagtaatgtctctttaatcatgctatgctagggaagtacattatggtctctccctctaagaatatgaagaggaaattttaccttcaacaaacaagcaaacttagttatatttttgtgattttatgctgttttcatattctattttgagatctatttgtcttagcttggaggtggttttgttaaatgtccacgatttagagacggcataatgaaaaaatgaccaagaatttggttgggaatgggaggagcttagaagaacaagaaattggctttgattttatagtgtatggtgctctgttggtagctggacatcatcacaggctttggattgagaagacctgttctggagttctagttctgctactgcctagcgttgtgatcttgatgaagatactcttccttcctgggcttcagtttttgatctataaattgctagtgatggggctggactatttttaagtttgttctaactttagcagtcttaagaattaaggttgcatgccagaaaatagggttaaatatttgtttctgatctggttacaaaaaaaaaaaaaacttgatggcttaaagtaaataaaaattcaacagtacggtgtaaatttaaaatgaggcaaaagaaagataatgacttaatttttattttaatctttcttatagctgttttatataagaacttttcatgaatacaatcaaaatgtccatgagataaaaataagctaattgtgcaggaaaagtacaaatgcactttttctgcagctctaacatgtaaggtttgggaacaatcgttgggcctgacaaacagttgagctagggtaagggtgaatgccttttctggaagcctatcaagagcatcgaggtgaagtcctcttacctttaatcatgggagagcccattctggaccaagggtttgagaaaattattctgactgtgttctaaggtaataggtgaatgggtgctcaagggcccctgttgcatttcatgtagacttgccagaagagttttagcttgaaaacatcataagatgaatataggcagatcccaaactcagtaaaaaaacagctatagaatgttgctctatcctccaagatgaacactttacataatgtttgtacaaggtggcttgtgtgagtttgttgataaaccagttaaaagttgggatatcccccagctatcccaaaagaagaggactaaatacaaccatgttttagtctgctagagacttgtgttctgacctaagacctgtcagaagacctgtcccactggctctgcttctgtactagtactataaggcaggttctgtgtgaacattaataaccaaggatcctgagttagacttatagtttggtcaataaccaatttatacctagattgaaagaccaaggaaaagttaataaaataatcaacaatctggtactatttgagggaaagtagggctatcctatttggagatggaataaatgggataaattatgtttggggcctgaatagacaagatcatagcttgtatagtaagggttcttaacctggggcttcagagctccagcgagtctacagagagactatttgatatgctagttttctttgtatttctctgaatttaattttacgtgtttaaaaatatgatgatgaaaagaggcacatggtttcatcagattgccggaaggatccatgatacaaaacagattcagaactcctgtatgttgagttaaagtgaacagattagtaatggttggagcatgatattcagagtagttcctgaacagctcttgaatatgagaagtctttcccaggttttttgttttgttttgttttgttttgagatggaatctcactgtcgcccaggctggaagtgcagtggcatgatcttggctcactgcaaacgcctcctgggttcaggtgattctcctgcctcagcctcctgaatagctgggattacaggcaggcaccacaacgcctggctaatttttgtatttttagtagagacggggttttgccctgttagccaggctggtctcaaacccctgacctcaggtgatccacctgccttggcctcccaaagtgctaggattacaggtgtgagccaccgtgcccagccaggtttgttctttggcttgagttttttcatcagcagtagccagagtagtttctcggataattctcccaagctgctttctttttagggaatcagaaagactattaaatgagtttaacttttatagctacaaatttattcttaagtgtatttcaagctcatatggctctctagtattaatattgctagtagcagcctaagtgtgagtgggtgtttctggcaaggagcaatttccattttaattgacattttcttctatgtactaaatcttggatgccaagagctttcctcactggtagttgtaaatgctaaatctatatacttaacttcatccccttctgtcaagataaatgcaaacttcatttcccctcaaaggagttcaaaggaaaacttcttggcgtgtttggggagatgttttcatccaccatcacatggacccaactgcaaagattttcagtgcctaaaacaagctcacctgtcttggttcttctgaaacacgtagcagttgaaaagtttagaattgttcacttgttccaaattctatgatagagaggcggcagcaatacattcattaatactctaaatgagagtatttgatgtcctctaagtttattcaggaagtatcttatgtagctaagaaacatttgtagagataaaggtctgtttgatagcctgggggcagagggataatgtttgcttaataaagatgatcgttttgggatgtgccttagaaactaacaaactcgcatctcctatccagtgatccagatctctgagctaaggcacatagaggtctgttagtaaaaagggaatggcaggtttatttaggtttggttaatactagttttttacagactataggaagccttgctattttgcttggaatagtttgttgcaatagtttattctaaaaaccaggtgttgaatttaatatatggcagcttttatatttttatataggatttatttctgtgaccctaagcacaagcaggcttttttttttttttttttttttttgagacagttctgttgcccaggttagagtgcagtggcgtgatcttggctcactacaacctctgcctcccgggttcaagcaattctcttgcctcagcctcccgagcagctgggattacaggcgcctgccaccatgcccagctaatttttgtatttttggtagagacagggtttcactgtgttggccaggctggtctcaaattcctgatctcgtgatctgcccaccttggcctcccaaagtgctgggattacaagcgtgagccactgtgcctggcctgcacaagcagtttttatgtgccttcccttcagttatgttcgtgctcctcagaataaccctgtaaagtaggtagggaagtcatcttcattttatagttgaaagactcaagactcagaaataaagtattcacagttttgtattaagttggaaaaccagtactggaacctggggggtcttctaactactggcctgtgctctttaagctgcaatagctatcccactttgaaaagaacgtatgaaatacagttgcagtcatgtatactccatctccaaagaatggattcattcttcatgtcatggtatattgactataattttctgtttttaattacccagattccaagcctgtttatagaacttatacctgaggaatggtgaggattagaagaggccgcagtccttgaggttttctttgatgataatatctgtaactgcatcaaacacaaatttgacattctgtgtatctgtagcacaggtcatgtgactgtagatttctttgacatcttttcgcatattgaggtcaaggaactggctctttatgtaattccccgcatcatcataggagttgttacctggttttccagaaaaatagtgaaaaagtagaataaatgaacccttgttagttgctgactcactttaggtgattgacttgatccttgaaatgttattagacaacagcagttgggggcctatttttggagggaagattctctattgcactccagtgtttctcactttagttgaaaagaaattgaggagaggtgtctttccacctttggttttcagtaggtatcatatgaagtcagtggctctcctgcatctaatgcctgctgtattccagagtatctgaatttaaaccctgtaactgtgcccaaggttctcccttaagttcctttgtgtcatcttggcctaaaaaatgagacaattgccagtctctactaaaaggcattattattatttccagcccctgacacttaccatcatactctggaaaacaaatgctgagatggactttcttgattttttcctcaaagaggtccttcttgttgagaaagaggacaatggaagtagccgcaaagaatttgtggttacatatgctgttgaacagatgcaaagactcatgcatacgattctagtaagaggaaacaccattggaaatatcagatttggcttatagaatatctacctacttcctgctcttgttccccttggagagaccagtgctccaaatgtaaaaagcaagacagagaacagcttatctcaatgtaccagagtaaagccagagagatgtgggatcattctagttccctatctttctaatagctgtgtgacttgtggaaaattattgagctttttctgagtctgttttcctatcttatagggttacaatgaaagctaaatgagattgtgtatgtatattgtccatgatagtggctggcatataggtctataatgtgttatgcagatctttagcagccaggatgcaactgagaacttgacattttataagtagtgctgataatgggttgaaacaggcccaagttagcatgtgcccatatgcatctccaggatgattttgataggcttctttcatggggtcccagatctcagtttgggctactttggtcctgctgccacatggtgagagttagagaatttcccagtgccataccacaagcatttctgctctctcatttccttctctgattgctacttagcgagaagtcgggctgcatatctgcagaggctgcccattgccccagcccagcttgcttttagggagcaggtctttagggttttgaagtatactatcagctgacttgcgttcagtctacttatctaataaagcaagaacaatcccatttgtggctttttccccataatactcctgtacaaccctttaaggtctcatagacttgttttattaatgtctcatagactttaataaacctcatagactcatagactttagggttaaagatggaaagtctcatagactgtaatctttaggcttaaagatgggaagtgaatagctctgtaagacattttgattagacgatattcagagtgctctaatgtgaagttaaaactaccaaagggaagggaagagaacaagctgtggcaagggataggagtatccctttcatcagcaagctgtggacctccatttgtaagcagatgcttgggtgaaattaacatttttcacgcctctaacctttcccaaattcagaggtcatcagcaaggtgtggacctccatttgtgagcagatgcttgggtgaaattaacgtttttcacgcctctaacttttcccaaattcagaaagcagatgcttgggtgaaattaacgtttttctcacctctaacctttcccaaattcagaaactggctgggctctaacacttgtcctatagaactcctgtcctacagaattctacaggctaaagagaaccactcttgggtagtcttccagctgccaatttaattggcatgagagaaagctggtctgccagtctctccttaaactcctacggacagtacatttttagcctcctaagtggggttactagctcaacccttctattatgttgcaatgaagattcatatcatatgttattttctctgttctgtcattttcatctccttccttaggcaatttgggagagtactaagtgtaactcctttgctttgcctagttgatggtcccttatctctttgcactcaattcctcttatgagctttgtgatgtccaagtgatacttagatgtctaatttgagaccaagctcactgtcagtaaatttggagctctaaaatgctaatctagaacctgcagaagaagttgttttttagaattatttgcatgagacattgattggtctgctggagggctgctagactgaaattacctaagttggggcagtagagtgacacaaggcttagagaaagggtcatggggagaacttgttctaccaaagctgcttgatgcaaaggccactcaccacttcgtcatcttccaccagcaccatatcataggcactgagggctgcacagaaaatgatgcaggtgactccctcgaagcagtggatccacttctttctctcggatctctgccctcccacatcaaacatcctgagggaagaagcagctattttcataggtatgcccaacatacgacctatatgcctttgatggtcaccccgtgaagtgggagaggaaaagggggagaagcagaacagtaatttagattaggcttcaccaaaggccaagaagcctgcctgtgccccttttcaggattccacacgtgtatccgagatgccctagggaaccatgcacttacctgaaattcaagtctttgacggaaaacttggtttcaatgatgcccgtggttttgactctggatcggagcacatcttgctcactagggaggtactcagggtctgtaattcgttctaattggttcaggtagctagagaaaagtgattagcatcaatgacaaattttccacagacgaggctaagagacgtaaaaggtatcttacccaaagtcacacagctaatttggtgatagaaatcaggactagaagccatattgttaaatttaggattctttccttcaaaccttcatatgtcattaactagaggaaatgggggatggactgagggacaagcccatttgaggctggagttccagcgcatttaaatcaagttagataagttttccttgggtttgccctgactgcaagcttttgtagatttttgaatgagatttagtgggtgctaaaagttccatcaagaggcagtaaattgaaagagactttaaagacatgaaccaatgcaacacatggactttgtttatatcctgaatcaaactggggaggaaacatttgagataactggggaaatttgaacaccgacttggtgatatttgatgctattaaggaattgttaactatttgggtgtgattatattctttttataaaaagggtcaatattttagagatccataatgacatttttaggatgaaatgatacctggaatttgcttcaaaataatccagtagggaatggaggtaaaaagaaataagattggccatgagttgataactgttgaaggtaattcattatgttatttctacttttgtatgtttgaaagttaccttaaaaaagaaaaagttattttttttaaaaaaaaaaaaggtggccaggcacggtggctcgcgcctataatcccagtactttgggaggccgaggcgggcggatcacaaggtcaggagatcgaaaccatcctggctaacacggtgaaaccccatctctactaaaaatacaaaaaattagctgggcatggtggcgggcgccagtatccccagctacttgggaggctgaggcaggagaatggcgtgaacccgggaggcaaagctggcagtgagccgagattgcgccactgcactccagcctgggtgacaaagcgagactccgtctccaaaaaaaaaaaaggcaagaggaaggcagatgtgaactgagatgactgagaggaggagggaagtacaagtaacacaagtgcctattgtatgccaggcattttaatgttcagattctcgtttaaactcctaagccatcaagtttcatatccccattttacagatggagaaattcagaagagttaaatacttggctagggtcaagagaaattgtggtgtattatgaaaaatattcagctttgtagtcaagcagcccaatgcaaatgcagtctctgctatttatctacatgaccttgggcagttaattaacttctctgaacttcagtttttccatgtgtaaaatgaggctaattagaaaggtaccatctaccttaaggtcttactgcgtagatgggtaaagggcgttgagatggtatacacagtacacctagcagtgactgggctttgagtgctccgggaacagtaagtgatagcattattacaagattaggagacagatggttaggttaaataaactcaggtttgactttgaagcccatacttgtctatgatcccatactgtctgaggtaggattgataaattatgtcccttagctttttggaagcagctttgcaatgatggtactaattcctgaccaccttcccttggtttgcccttgtagtttgtgtcccctgccttggcatcgtgacataagatgctctaggtgtaggagactcatttctgcttagtggcctaagtagatcctagattaccagatagaaaattctgccctgaaagagccatcatgaatcacattactcctgcgagagtgtatgacagaactgcagggctatcttagggttctggaaggagaggcttagtgtacacctcaattaagagaacagggctgagggctactaggcagaacacgtcttttgaattttgcatcttcagccttgtaggctgtagtgagccagtgtaaagcaatagaaagtcatgacaactgtggcagatctccccatagcattaaattcaaaacattgctgaagcctaacaaaacagatccacaggctgaattcagtctgggtctccagctttcaatgcctgaaattttgggttgggtgaggtttctcccaaccagagagaagactggctagaagattgcttaagcatcaacccaccctctcaccagtcagtcttactaagatgcggagtcattaagctggtattctgcagctctctcgaagcaggcttgcaccccaccatccttccacaacctcctaatgacctccacgagctcaggaggcatggttccctcctcaatggagtcagccaggttgttgagctgtcgcccgtcatcctgtaatgcagaaacctggttaagaacttcacaggagtaatagctttccaggaggcttctgggaatactgctgaatggaaatcattttacattactacgaagacctaagatggaagcagtatccagtgaagattctatgtaagaaaacatactgttgaatttttgagtatgctccccagatgcagagggtggcactatacccagccctggggtgtgtctaaagcggggcaggggtcccaggtatttcctctctggagtttctggcttccatccttagtctgaaagtttaccgccacaaaacgtgggtcctctgctgcagagagactgaaaatgtaaaggccagattgaccatgaaatagacaagatagaagacagggacccatcacctttgttcttcagcgattgaaagctagaaaaagtccagtactagaagtagggatttcacttacaaaagttccatggccaggaacccaagggtagcaatttaaatggtaaagtaaaaaagcagaggaagctgtgagcagctttattttgtaaatatgtgttataaagtagggcttgaggacaggcacggtggctcacacctgtaatctcaacactttcggagtctgaggcaggaggattgcttaaggccaggagtttgacaccagcctagacaagatggcaagaccccttctctacaaaaaaattttaaaaaatagctgggtgtggtggtgcacacctgtggtcccacctactggggctgaggtgggagaatcacttaagcctgggagggtgagattgcagtgagccatgatcacaccactgcattccagcctgggtaagagaggaagaccctgtcccagtaaaaataagggtggatgttgcttacttctccaggactgcataattgtggtgtattatgaaaaatattcagctttgtagtcaagcagcccaatgcaaatgcagtctctgctatttatctacatgaccttgggcagttaattaacttctctgaacttcagtttttccatgtgtaaaatgaggctaattagaaaggtaccgtctaccttaaggtcttactgcgtagatgggtaaagggccttgagatggtatacacagtacacctagcagtgagatcccacccagcaggtgggattttagttactatttttcttacccatctttccatatagtttgttggcctctggtatgtttcttcttgctagcctttctgcttccacccttaaccacataatagtaatcacataccgcacagcttggttcagcataatcgatgcccagtgtggtcatggcccggatgatagccaggatggactgcagcacatttccatagatgatagccttgaactccaggcattcttctggtgaatagccatcctggtgaatgatcctgcaaggggcagacactctgtctttagctggacctgagtaaccagacctaagggattaggaatttgggggtatttaaaggatcataagaatcctatctctctgttgctactgctttctcaaagtggagggtgagggacaaggggtacagatgaggggcattggaatcagatcctttatacctgggctccttgaggctaaagagcctttcactttgaatacctccactggctgtactgacttcttcaccctatcttgtcttttggggctttgtttctactcacttcatctgtttgacgatggtgctctttcctgactccccagcacctggaaggaaaaatgcttatgctttcgatttccaccagttctcctcagccttccaggagatggcctgggagaagtcagagccactgcttgcttgggggtcttgttaggggagaatacatagggatgactgctgccctcaatttctggcaggcttgagctcaggccattcaacctggatttagagcagtttcttaacttcagtactatttagtttgggctgtctcatgcatggtaggatgttcagcagcattcctggcctctacccactagaggccaatagcatcccacttccctagttatgacaaccaaaagtgtctccagacatttccaaatgaccactggcagtcaaaatcttcctgttgaaaaccactaacagattcagggggagtcctttaacatttctcctctctgcctatttttgactcaggagagtgatcttggggtaggattggagagagctggatcatttcaccaaaataactatattttcatcaccttgctggttcccttttttttttttgagacagggtctcaggtttgtagcccaggctggagtgtaatggcacaatctcggcttactgcagccttgacttcccaggctcaagtgatcctcccacctcagtctcctgagtagttgggattccaggtgtgcgacatcatgcccgactacatttttttttttttttttgagacagtcttgctctgtctcccaggctggagtgcagtggtgctatcttggctcactgcaacctctgcctcctgggttttaagcaattcttctgcctcagcctcctgagtagctgggactctacaggcgcatgccaccatgcctgactaatttttgtatttttagtagaaatggggtttcactatgttggccaggctggtctcaaactcctgacctcaggtagatccacccatcttggcctcccaaagcgctgggattacaggcgtgcgccactgcatccggccatttccccccgcccctccgtagaggcaggttttcaccatgttgctcaacctggtcttggatggggctaagtgggttccctttattgactaatgtgtcctaatgtcctcattcacactctgctctctccatcaaaaactcataccttctagtactgagtttatactaccctaatgcctcgaactcctcctatttcgcttgtgcttgttccctctaagcagcttatcctgaatgtagaagaaatctgcttaggcttaaaagatctctcagtggccccaccatctctgtttccccctgcgtaacctcctgggctccttagagtctggtccagcttacaaagatatgctcctttagtgtgtccttacgactgtgccacagatcagctgggggaaaagaaggtgccttagcctagtgcgtcagctcccagatcccttatgggggcttggaaacccagctcaggcatctaatcttctgctacgtagaccctacctgctccagctaccctacttctgtggtaccagtggtttgttttcctaagccacgtgtctcaaatgttcttgtcttggttttatttacagctgtgatcaatttccctgacaaattgaggtgcttttattttctcagcacagaccagtgatctgcttaggagctcatcaagttgatgaaccttccatctggcaggagctttgcaggcagctattgaatagagagccaggaagggactgctgtacataaagacaccattcctccttcctcagagccccctacttccaaagtttttactgaaagcaagaaggaaccactatacttggcaaaaaccagtgggactatctctggtactgttggcactgactgtatggtgggacttgtgagcctgttggtgagggaaggtcctgttctcttctgatttcttggcttagagttctctgcagattgggtacagtctgcaagtccagggtccttgaagccaaaaggatgtgttaggtttggttagatttggaaatgggtgggttcatggtggcccttgcactattcctcgctcaagagtagaaaaactctggaatagccttggcattctggatccccttggggtggctgtttaggccccatattaactcagctctagatctcctgatcccctagccagactgtgtagaggagaggaaaaatgacctgccacccttccttcccatggggtgaggtagaacccaccaacccttcaggaaagtaggaaggacccctgccttctctggctcatcttcccatctcactcacccagcagtagcagcttgacagtcttggcttccttatcagcatcctcctgcagcttcttttctagctccttggacctcttggccagttctttgtcctcagcactggctccacttcccatatttgccgtcttgtcagctttttcaggcccctaatcctctctcgtaaggtttcctgtatgtgagatggaagagaaggaaaaaagttgggattgagtatcccaacttggctcccctaaaagctggtctgtacgatggcaggtgagagagcaggctgtagggtcttgtactctgcctacattgactgagactccctacttcaactggagacctacttcttagtctagggattgtagcctttatatctagcaatgtgataggtcaagccaattaagagctttgtcaatatggcaaggggtaaagactcaaatgtttctataactagggaaatgatctgctgggttctgacggaaggataggatgcacgactacttccatcctttaaggggttcatcccctgaaagtctcttgcttccttagatttatttgcatcatagagctagagattactggcacatatgtagaaagcattccttatgttgagcctccagattataaggtcttgatctcaagggcttcagggtatcaaagcatactcgtttaccataggctggtcctggccaggaaatttgttttgggtggtgcccttccttgggaagattaggaatgtttcagctcccgcagtggctgctgctccaggaagctactagcattgttcctttgcattggcccctctctttgtacttctgttattagcacttatcacttcatattgtacgtcgttttacaaatcttttccctcactgcatttctccccctggagctcaacggaccaaatctgactcatctttgaacctctcagaacttgtagtttatttgtggatcaaaaggtttggtgaatgaataaatgcaggaaaagggtgtatggtgaagagaatggggttgcttccctttggcccactaaagccagctgagtcccaacttcacttcataaatgaactttgctggtattcagtgtggggtttgtgctgcctcacacaaaaaactctgcttctttgggaaattggactccagactctggcttctcaaaggttggggcagctctctctccttctggctctcatcccagctgccctttcctgggggaaaaatgagggtgcagtctagcaactgcctcacagacatttaggactccacaggttgtactcctctatgccaattatttcagtttacttaaatgagtgttgctggcggagcctcctcaggtggagatgttttagaattttgttgcccaaaatgtggatcaagagccagcaacatcagatcacccggaagctcattagacatgcagaatctcaggctttaatccagaacttctgattcagaatccgcagtttaacaagatctcaggtgactctaaagacattaaagattgggaagtactgccctagggacctgttttccgctaaacttacctaatcctaagaatcacctgggttgctggtgtctgtgtttcctcaagtcttaggtgccactgactagaagattaccctgctttccgagatgttaaaatagtgtatgtttttaaatggtatgttagcatcaaactccagagccagagaaaatattttaagctaatacaggtagttatcacatctgtgaagtttgaaaaaccctggcctgaaacagttctcaacttttagtgtacagtggcatttacctggagagctttttaaaaaatactgatttaattggtctggagtgcagtccaggcacaaggatttaaaaacgtccccagctgattctagtgtacagccaaggtggagaactactgaggtcgaaggatgtaatttgctctttcattttagagctggacttgtgcagcagtggccagttgggactgggaaggtcaggagtagaatctaggtctccccgcctatcaggtaccctgagccatagctaattatcttcctccttcgcaccacctttcagtgactgtaggggctgatggagaaatatgcagctgctgaggtgctttccatggtagccatgttttcccaatcaaattggcaagtccttattgacttaaggaaaaacaggagagtctctttgaaattgtgactatcttggaatcttggttataaggtttcagtaattataccccactgctagccctgctccagcgtactcacaatactggtaactcacactgaggccagagccatgctgaaggctacactgttcaaggggctgcctggaactattaataattattatgttatagttattataattaataactgctgaacaatgtaagtggctcataccagttaattatcacaataactgctattgtccccaatttacagactagattaactgagacttgagagttaagtaactcatttaaagtcagctgggcatagtggcgcatgcctgtaatcccagcactttgggaggctgaggtgggtggatgacctgaggtcaggagttcctggccaacatggtgaaatcccgtatccactaaaaatacaaaaattaggccgggcatggtggctcacgcctgtaattccaacactttgggaggccaaaatgggcagatcatctgaggtcaggagttcgagacagcctggtcaacatggtgaaaccctgtctctacttaaaaaaaatacaaaaattagccaggcatggtggcaggcacctgtaatcccagctacttgggaggctgaggcaggagaatcacttgaacccgggaggcactgcactccagcctgggcaacagagcaagattccgtctcagaaaaaaaaaaaaaaaagaaaagaaaagaaaagaaaaagcccagcatggtggcatgcacccagctacttgggagatagaggcatgagaatcgcttgaacccgggaggtggaggttgcagtgagccgagattgcgccactgcactccaacctgggtgacagagtgagactctgtttcaaaaacaaaaaaacaaagttatatggcctagtaaacagacaaaccggtgatccttctttctattacttccacataagtagccagagagagaaagcatggacaaatgcatgaactctataacagcagcccttgttaaaggaaccactaagttgtttcacacacagggaaagtgggcttgttcctttttctgctactacctctgcaaacttctgtgctgcttctgctttgttccctaacttactggatggaagttcccctttctcactgctaagctgagagagggaactgctagccctcgcctggcctgagagtacagatccattactgtgcatacatcatcctgatgtctgtgacctcctgcctctgcctctatcgtcagttcctgtgcctttcctgtggctgtcccactttatgatcacatttacgaacagtttcctgatgaagtaaataaggtatgtagtgctagttccattttggaggtgagtgaactgaagtacagaaaagtgatcctcacattaataagcaagttggtatcagaagccaagccagagctcaggtgttttgattcacagccctttataaccattatcattttgaatgaaaagtaaatcactgtttcttagtgatttgggcatgtttcctgagttaagggatctgtctgacatccgtggtaagccttgtcttaagtgaattgtgggtaaagacttgtcccagatggagtgggaggacatgaaggatgaggaactaccttcaggaccttccagtccataggcagaggtgggggaaattcacagaaaaacaaatgagttaaagggatactgcagtagtgctgggaaattcagagctgtttaagacctagcattcacccctggtaggaaaggcaatcaaacacacatctgactgtcagactgacaaagttctacagcggaagaaagaaaagggtgattgtgaaatgaatagactttccacagagaagcagaataacagtggaagtgggagatacgcattttggggaaaggaaagagcatgaaaaaagaggtagaggcacaaagtacaaggtgtgctcagagaagactgggactttgatgtgactggactggagtgaaaggtgcatggagtggagggttgggaggtgaagatgaagacaagaaagggaaattggagccagccagtgaagcgccttcaatggcaaggggtttgactaaaatccactggggtcttataaacaagtatagatggaaacagctgtatggtgctataaacacaatgctgggtgactgaggtgagggggagagggagctggctgctgggagaagctgagaaaccagagctgaacagcttgtttctagaagggcctaggcataaggtatggtttgggaaattgccttggccaaggacctttttggagctgcagatattctctcccaagtttagtatctgtgaagattgttctggcctagctagggaggcggacatcacaagtgagctgaagtccagaagcaaagaaaagcacttcttcagagaaacaggagtgcaccatctttagggagctgggattccgggagggccagttaaggagccatgtggggaacaggctaggaggggaggaagctgtgtttggagctagggaatatctcagaggctcaaaggcaatgaatgttaaggcctcagtgtgaaaaaagcccaggccataggatgactcactcctttatttcccaagctctgttctgcgtagacaatgaaacctcactgagattcttgctggtatggagtgggtggagggattgatgcctaactataatcagggccgacttcctagcagcaacaatacaccagatgacctggaaataggggagggttgtagagtgaagggtgtgttgcagatgggactaggggactagcataaagggactaatgaactggtttgcctgggctgggtggagggcaaggattgccacctattggctgctgaggtaggtaggtctgcattaagcaggatgctcaagagacctggcccaatgcaagatactatctttaaaactatgtcaacatttgcatcttatcagaagatacatgacatttatgtagttacatggtgcttgatttttgagattcattttattcattcttgagagtccatcagcctcaaaatccctaagcgccccaagaccaattcagtgggccataaatgtaaacagaatagtttaagtctggggttaagaccccgggaaggctgggttggggggactgtggaggcaattacagatttttacagatttttgttgatttctatccccttgattataaaagttatgggtatgtattataatttctaaaatgcaaataaatataaagaaaataaatataacccataattccatcactacagataatcattggtaaacttgttggtgtgtttcttttctacccatgtatatcacataagtaggaccatactgtgtatagtgttttgcatccattcttttacctaactttatattgtaaacatttccacatcattaaacatttctccaagaa

SEQ ID NO: 139241 - DNA, 2417 bp, Homo sapiens
  Payload ID: 7292
  Gene Symbol: GNAT1
  Gene Name: guanine nucleotide binding protein (G protein), alpha transducing activity polypeptide 1
  Uniprot ID: P11488
  ENST ID: ENST00000232461
  CDS Start-End: 115-1167
ttgattgcaggtcctcctggggccagaagggtgcctgggaggccaggttctggggatcccctccatccagaagaaccacctgctcactctgtcccttcgcctgctgctgggaccatgggggctggggccagtgctgaggagaagcactccagggagctggaaaagaagctgaaagaggacgctgagaaggatgctcgaaccgtgaagctgctgcttctgggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcgcaagaagtggatccactgcttcgagggcgtgacctgcatcatcttcatcgcggcgctgagcgcctacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaagatcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaatttgtcttcgacgctgtcaccgacatcatcatcaaggagaacctcaaagactgtggcctcttctgaggtgcctgaattcatgcgtgtcagtcaccctgagacctggtagccctagctgccttgcagccccaaaccccaggaccctatcagccccctgggactccctggccccaacctgccacctcaccaaagctctgagccctgctagccttgaggcgcggaccctcccccatacctcccacagtatcccagcgcctcatgcccccaaccccaagccctgcccttcaccgcccggctgcactggcctctaggactcacagcagccagccccagctaggaacgggcaggacttggggcagctgaagctcacggtgactcagcagtgcccaactgaccaatctcccgcagctctcctgcccctgggggcccacgactcacctggtgggcctgggctcagcaaacagccctccctcccagtatttcatcaaggacagggaatatccctcccacacacaggccagctgctcaccctgccacctccatgtgacaagtttgacacctgtctacccagagccagtgactgtccctcccagcagcctccaaagggtccaaagtccaagctagctctggcctgtgtggcccccacataaataaattagtggggagggggcagacctgggggcccttgggtgccagagtgagacacagcaggacccttccccaaatactaggctcagagcaacctccagccttctccagcaggatctgctccctgtgtccttggacagcagatccacacaccacttccccacccacacacagtaccctgggctggttggacaacaggatggtgtgttaaggggttaagggagggtactgttgacaccagctatggccaatagctgggctgtcctgaggggtggctggggacagagtccagctcccttggatcagcccagaggattcaggataggacaaaggccctggctgtgcccaaaagggtctacctcaggtggggttacaagcaaacctgggtgaccctcttgtccctaccagcagcttctcttgccccttccattcagggttccctggcaggggaagctgagagccatggctgaactatcagggacaaaggcccatgtccccacatccctgctccctccttcctcatccagcaccaaatctttgcttatgtccacaggccagggcctgtgctgcagtcggggacaaggagcttccgtctggcaaggccggggcacaatttgcactcccctcagctagacgcacagactcagcaataaacctttgcatcaggc

SEQ ID NO: 139242 - DNA, 1224 bp, Homo sapiens
  Payload ID: 7292
  Gene Symbol: GNAT1
  Gene Name: guanine nucleotide binding protein (G protein), alpha transducing activity polypeptide 1
  Uniprot ID: P11488
  ENST ID: ENST00000433068
  CDS Start-End: 57-1109
ccctccatccagaagaaccacctgctcactctgtcccttcgcctgctgctgggaccatgggggctggggccagtgctgaggagaagcactccagggagctggaaaagaagctgaaagaggacgctgagaaggatgctcgaaccgtgaagctgctgcttctgggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcgcaagaagtggatccactgcttcgagggcgtgacctgcatcatcttcatcgcggcgctgagcgcctacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaagatcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaatttgtcttcgacgctgtcaccgacatcatcatcaaggagaacctcaaagactgtggcctcttctgaggccagggcctgtgctgcagtcggggacaaggagcttccgtctggcaaggccggggcacaatttgcactcccctcagctagacgcacagactcagcaataaacctttgcatcagg

SEQ ID NO: 139243 - DNA, 479 bp, Homo sapiens
  Payload ID: 7292
  Gene Symbol: GNAT1
  Gene Name: guanine nucleotide binding protein (G protein), alpha transducing activity polypeptide 1
  ENST ID: ENST00000440836
  CDS Start-End: 90-479
caaaagagctaattccctctgagcctcctggagacacctgcaccccttcaggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccact

SEQ ID NO: 139244 - DNA, 1339 bp, Homo sapiens
  Payload ID: 7293
  Gene Symbol: GNAT2
  Gene Name: guanine nucleotide binding protein (G protein), alpha transducing activity polypeptide 2
  Uniprot ID: P19087
  ENST ID: ENST00000351050
  CDS Start-End: 188-1252
ctcagtcaatgtaggcagagtacaagaccctacagcctgctctctcacctgccatcgtacagaccagcttttaggggagccaagttgggatactcaatcccaacttttttccttctcttccatctcacatacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgtggaggtcattaggaggttgtggaaggatggtggggtgcaagcctgcttcgagagagctgcagaataccagcttaatgactccgcatcttactacctgaaccaattagaacgaattacagaccctgagtacctccctagtgagcaagatgtgctccgatccagagtcaaaaccacgggcatcattgaaaccaagttttccgtcaaagacttgaatttcaggatgtttgatgtgggagggcagagatccgagagaaagaagtggatccactgcttcgagggagtcacctgcatcattttctgtgcagccctcagtgcctatgatatggtgctggtggaagatgacgaagtgaatcgtatgcatgagtctttgcatctgttcaacagcatatgtaaccacaaattctttgcggctacttccattgtcctctttctcaacaagaaggacctctttgaggaaaaaatcaagaaagtccatctcagcatttgttttccagagtatgatggtaacaactcctatgatgatgcggggaattacataaagagccagttccttgacctcaatatgcgaaaagatgtcaaagaaatctacagtcacatgacctgtgctacagatacacagaatgtcaaatttgtgtttgatgcagttacagatattatcatcaaagaaaacctcaaggactgcggcctcttctaatcctcaccattcctcaggtataagttctataaacaggcttggaatctgggtaattaaaaacagaaaattatagtcaatataccatga

SEQ ID NO: 139245 - DNA, 466 bp, Homo sapiens
  Payload ID: 7293
  Gene Symbol: GNAT2
  Gene Name: guanine nucleotide binding protein (G protein), alpha transducing activity polypeptide 2
  ENST ID: ENST00000622865
  CDS Start-End: 96-466
gtcggactcccgcggccggactgtgggggagtcacgcaacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgt

SEQ ID NO: 139246 - DNA, 3333 bp, Homo sapiens
  Payload ID: 7294
  Gene Symbol: GNAZ
  Gene Name: guanine nucleotide binding protein (G protein), alpha z polypeptide
  Uniprot ID: P19086
  ENST ID: ENST00000615612
  CDS Start-End: 660-1727
ggcggcgggcggcgggcggcgcgggagggcgggcggagggaaccaggccggccggagcgtgtgcgccgcccgcggtccggtcacgtccccgcgtgggcgccgctgcccgcgtcgtacggaacgagggcgccgcggccccgtgctcgccgccccgccccgccccgccctgcccggagcagctcggcagatgctctgtgctgcggcccggaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacaagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacattttttttttgttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagccca

SEQ ID NO: 139247 - DNA, 8906 bp, Homo sapiens
  Payload ID: 7295
  Gene Symbol: GNB5
  Gene Name: guanine nucleotide binding protein (G protein), beta 5
  Uniprot ID: O14775
  ENST ID: ENST00000261837
  CDS Start-End: 67-1254
ctcacctctcaccatctgctctgtggctcccagtgctgactctggaagctttatcttgggtaaaagatgtgtgatcagacctttctcgttaatgtatttggctcatgtgacaaatgtttcaaacaacgagctctgagaccagttttcaagaagtctcaacaactcagctactgttcaacatgtgcagaaattatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttgatcatttgcagagcagttactggtggttttattgtacactggggtctggggtagagagagaaaaatgaagggcctctgccttcctccagggagcccagagagagtgctttttagtcccagtagattccagtctgggcaggggctcaggaaatgggcccagtgtctggccagctcctgccaggtgctgaaggggtcagggcaccatgggattcctgagctctgctccagaatgtcccacagtggcccctggtgcagctggcctccttgtggtggcatccccaaccctctctcccacagccatttttttttttgtctctgcactgtgccttccggctcccagaagtgcaggaaggcacgagaaaggaaggaaaggtggcccagggaagcacattccaggttccatgtttggagaggtggagagcatcttcaggatatgtgcaaagtagactgtgactttccaatccaaaaagccactttaagggcccagggaaagtattccagagaatgcttccactccccgcatgggcaggaagcctccttcgctgtgagcatgcgctctcgcagtgggtgctgtcgggatttgctgatgagatacttgatttggactatgtgacagcatgtggagactcaggggtaagctccatgggatagattgtattttgcagattgaaaataatgctgagtgcattttataatcagcttttcttttttccagaggacttggggataaacctaccaaaccaattgtggtgaaggggccaaacagatgggcccccaggggtgtagagccttgggcagccccctcctgggccagaaaaaagaaagttcaggcagaaaggtgtgggtgatgggtatttatgggaaatatctgtgacatgaagccaagtccagtgctttagaatgcgcggtcagcctctcaccggtggggccctggcagccgtccctcttctcccaggcgagccagaggtgggcatcccgttgccactgccctcttcccgctcttctacctcctttgcacccttctctaggttataagtggcttaaaacagcacagggttgtaagggcctttgtgtcccgggctctcatagttgccaggccagctggctgaaaggtggcaccaccgatactgggactcctctgtgagttagagggatgccttggtgacataagagggctggccttcattcacacccacctctgtcacggtcacagaatatatgataatatctgagtttttctcagcctcagtttccccatttgtaacatgggatgggactaaaatatgtaaagtgcctacctcagcctttagcacatcttcaggaagggttagttcccagcttctccctgtgtcctcctcagtccccttcctatttgcccccctcccttctccctccacctatcttccctctttctcttcccttcccctcctcctccctctctcctccctctctcccatttccccctccctccctcccatctcctcctccctccctcccatctcctcctcctccctcccatctcctccctcccatctcctcctccctcccatctcctcctccctcccatctcctcctccctcccatctcctcctcccttcctcctgtcacccctcctccctccctctcatcacctcctccctccctcccatcgcctcctctctccttcctatctcctctttcctcttctctgccccctccccctctcctcattcatccggactcctttttctaacccttctcaatcttcccccattcctcatctcctcttcctctgtctccctgttccacctctctcctggtctccttccttccccttctgctgtttctccctccctcctcctcccttcccattccccttcccccagcacttccttttctccccatctcctccccattccccttcccccagctctttcttttctccccatctcctccccatccataggcagcccccactcatatagcaaattagtaattctcatcagttagagcttcgtctgggctagtggttctcaaactttttggtcttaggatctctgtacactttttttttttttttttttttacgtggagttttgctcttgttgcccaggctggagtgcagtggcgcgatctcgggctcacttcaacctccgcctcctgggttcaagcgattctcctgcctcagcctcccgagtagctgggattacaaggcatgcaccaccacgcccggctaattttgtatttttagtagagaccaggtttctccatgttggtcacactggtctcgaactcccaacctcaggtgatcctcccaccttggcctcccaaagtgctgggattacaggtgtaagccaccgtgcccagcctacacccttaaaagttattgaggaccccaaataacttgctcattgtggattgtatctatccatatttattgtattagaaattaagactgagaaaaagttataaaacacaagaatacagatgcacacgttccattagccatcaaggtgatctttctcccatgccagtagtctctggaaaattcctgagaggatgaaaataaaaaaatcacccatacaaaaaaaaaaagtgtcaatattattatgaaaatagttttgaccgtgaggaccccctgaaagggtctcagggaccctcgggggccctggatcttgctttgagaacagctgatctgggctaatgagcccttttccagcccctctgtgtgagacctcccagaaaccactaagggccttggaagagcttggcaaagaaagaggtgacaggatgattgaggagagccaccctagggaaagccttcagaggaggctttgggacagccccggtcggtggaggaagtcccagagaggcagtcggaagggctagggaccagctgaggcctgtgacctgaaaatcctttcaaaagaggacgcctggaagcctggggaaggcacagtgggtggggtagaagactggggctgaggcccaggccattcccaagcctggaagagctgattgagtggggatttgtagatcttcatttcccaaacttgcctgctgagaagaatcgtcccacccatggcaggttcctgcactgcgccttcagggccctgccctgagatctggactgggcgggcctgaggtgggccaggaaatctgagccggaggcccactggggaggccgcgagtgaatcttgtctctgtggatcctttgtaaggattgccatgctaaaccacttgccctctcatccgtgaccggagagaattgggtcactcttccagacataccacagactcctgcttctagacagcacttggctggagccaggctggccttcagggttggtcagtctccacaggggactctggcctcccgtgggctgccacagggccaaccccagtgaaagaaatgaaatgactgaatatgttcatgtcattagaaaaaggatgcagcagggggtggggaggagttggttaatggaatcaaatttgcagcaagataggagtctagtgtttggcggcactgtagggtgactatcgctaacaataatttactgtgtattttcaagtagctagaagagagaattttgaatgttcctgtcaacctaaataacaaagacaggctcgctaaagatatttaatcaaaagtagggcattgcaacaggaatatgtgtgctgtagtaaactgtgtgcatattccaggaggtaaagaaaaacaaaggtgactgggcgcggtggctcacgcctgtaatcccagcactttgggaggccgaggcgggtggatcacgaggtcaggagatcgagaccatcctggctaacacggtgaaaccctgtctgtactaaaaaaaaatatatatatatattagctgggcgtggtggcaggtgcctgtagtcccagctgctcgggaggctggggcaggagaatggcatgaacccaggaggtagagcttgcagtgagccgagatggcaccactgcactccagcctgggcgacagagcgagactctgactcaaaaaaacaaagaaaaaaaaaaagaaaaacaaaggtttttaaaggaaaaaatgaggaggattacataatggttttgaaataattatccttggctacaaatatcaataacaaaggtcacaccagtccgaggttggacaggcagttgctaggcagatgtctttgcagaagtaatttttgtgtgaggttgcagcagcctatgtgcaaggttgtaatttttgcagaatcttttgtgatcatttttggtattaggcatacaagcatgagaatcccctcttcatggcctccccagctctatttgtcatggtttgtttttttaaaacactagtgactctatttgaattctaacaactttcacattcccaacacaaatgatagacatttaagggattaatatgctaattaccctgatcattacacattgtatacatgtatcaaaataacacactgtaccccataaatacatacaattatgtgtcaattaaagatcattatttttaaaaataggaccagaaaaaaagatgcagaccctctagtaaggagatgggatcaggagtgattccatggttaatttaacccacataaacaactaatcgtaagtatggtatgagcgtttatgtaaagactgtgacaacaggaaatgtctgtctttgaacccaaggttatctaaccagcacaccaatggtgaaagattaactttgtcagaaaccaggaaccatgaagcagaggtcactgtttccaacctgtgtgttttccacggtaattggcagcctccccaagggaaattaaaacatatgtccacacagaaatttgaatgcaaatgttcatagcagcattactcataatagcccaaagctgaaacagccccaatgttccacagtggatgaatcgatgaacaaaatatggcgcatccacagaatggaatacaaagaaagaaagcgtggacacatgctgcaacatggatgaaccttgaaaatattgtgccaggggaaagaaaccagagacaaagagccacatgttgtaggattccatgtatatgaaaggtcctaataagcaaactcataaagacaaaaagcagattggtggtcacttagggctagggtgaggagtgacggttagtgggcactgagtttctccggggggaactgaattagatggtggtgattgcacaattctgtgaatagactaaaaaccactggactgtaagagggtgaattttttggtatatgaattacatctcaataaagctgttacttaaaacgtggaaaaaataataagcagtcactagctattctcaataaaacagaaaccacataggtaagaccaatattgtcacattttggttttggctgataatggggcaagtgagcatagtcaccgttgccagaggatttaccatttacaaataaaagtttctgtggagtgacaaccttttactgtgtgccaggtactgtgctaagcactttgtatataccgattcatgtaatccttgtgacagccccgtgatgccccatttttagatggggagattgaggttaggagagttgaataacttgcccatagctgcacagcttccaagttgcagagacaggattttcaccgagtcttattacaaactgcctcatattgtgtggactggaaattctatgttgaggttaatttattcatttgttgtttagttcttttcatcattgttgagttaccaatggcagttccagaggatttatcatttaccccaaagctactgcaaatctaagagaaaacaatgttcttgctgctaaagtttaatgtacaaaaaggtaaaatcatgactgtcttgcaaataaaacatgaacatgta

SEQ ID NO: 139248 - DNA, 1735 bp, Homo sapiens
  Payload ID: 7295
  Gene Symbol: GNB5
  Gene Name: guanine nucleotide binding protein (G protein), beta 5
  Uniprot ID: O14775
  ENST ID: ENST00000358784
  CDS Start-End: 123-1184
atcgcggagggcggggccgcggggcggtgctcggggccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagc

SEQ ID NO: 139249 - DNA, 2678 bp, Homo sapiens
  Payload ID: 7295
  Gene Symbol: GNB5
  Gene Name: guanine nucleotide binding protein (G protein), beta 5
  Uniprot ID: O14775
  ENST ID: ENST00000396335
  CDS Start-End: 9-860
gcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattata

SEQ ID NO: 139250 - DNA, 918 bp, Homo sapiens
  Payload ID: 7295
  Gene Symbol: GNB5
  Gene Name: guanine nucleotide binding protein (G protein), beta 5
  ENST ID: ENST00000560116
  CDS Start-End: 22-402
ccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggtgaggcattgttcccagccacgttatagaggcttcagaatcccagcctacttaaaggtgctctggtccagctgcccggccctgtcctgatttctctccatgtatccctgcaagcagttgcctctacggatggaaaccccaagaaggcctatccgtgtttgaacagctcagccagcccattgcagcatttattcccctctcgccccaagaggacaattagagccaccataggggctgccaataccaacatggaaatgggcaaagcatggaaaacttgcaaccacatgtgcaactgcatgtactatttgtcttctgagtgataagaggcaccaaaattctccattctctctcccctctctttgaccagactccatagccctgtgggaatgaacacgtggagggtggggaagatgaggctgcagtgggactgggcagagctaccctgtgatgcagtctgatccccttgcaagtctggcttgggcatgcacagctcaacttagatttaaattttagctcttaatgaaaataagaccaaaacctatgtgcaggtatgctggaacacctgcattgcattggcatttacaataaagagtattgtgtattaaa

SEQ ID NO: 139251 - DNA, 673 bp, Homo sapiens
  Payload ID: 7295
  Gene Symbol: GNB5
  Gene Name: guanine nucleotide binding protein (G protein), beta 5
  ENST ID: ENST00000558519
  CDS Start-End: 1-312
gccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccgatgaggaaactgaggctgggcaagaggaagtcatttgccaaaagtatcgcaggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcaga

SEQ ID NO: 139252 - DNA, 586 bp, Homo sapiens
  Payload ID: 7295
  Gene Symbol: GNB5
  Gene Name: guanine nucleotide binding protein (G protein), beta 5
  ENST ID: ENST00000561313
  CDS Start-End: 95-397
gctcggggccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaagtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagag

SEQ ID NO: 139253 - DNA, 3132 bp, Homo sapiens
  Payload ID: 7296
  Gene Symbol: GNB1
  Gene Name: guanine nucleotide binding protein (G protein), beta polypeptide 1
  Uniprot ID: P62873
  ENST ID: ENST00000378609
  CDS Start-End: 333-1355
aggcgtctgaggggcggacggaggcggcggcggcggcggcgggagcgggagcgggcggcgagtggggagcggggccgggagtggagcagccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgaggga

SEQ ID NO: 139254 - DNA, 684 bp, Homo sapiens
  Payload ID: 7296
  Gene Symbol: GNB1
  Gene Name: guanine nucleotide binding protein (G protein), beta polypeptide 1
  ENST ID: ENST00000434686
  CDS Start-End: 188-684
gtcggcggccggagcccccgcgcgggccgcctatcgggtggagatggggtttcaccatgttgaccatgctggtctccaattcctgacctcagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtg

SEQ ID NO: 139255 - DNA, 602 bp, Homo sapiens
  Payload ID: 7296
  Gene Symbol: GNB1
  Gene Name: guanine nucleotide binding protein (G protein), beta polypeptide 1
  ENST ID: ENST00000439272
  CDS Start-End: 113-602
gcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgaatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcaga

SEQ ID NO: 139256 - DNA, 423 bp, Homo sapiens
  Payload ID: 7296
  Gene Symbol: GNB1
  Gene Name: guanine nucleotide binding protein (G protein), beta polypeptide 1
  ENST ID: ENST00000437146
  CDS Start-End: 101-423
ctggaaggtctgggggactgagggaagcgaagagaaaagcaagagcaattaaatatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttc

SEQ ID NO: 139257 - DNA, 3145 bp, Homo sapiens
  Payload ID: 7296
  Gene Symbol: GNB1
  Gene Name: guanine nucleotide binding protein (G protein), beta polypeptide 1
  Uniprot ID: P62873
  ENST ID: ENST00000610897
  CDS Start-End: 345-1367
gagcgcgtggggttttccgaggctgcgggcaggggcccgccgcgcccatcccgatggctggaggcgtctgaggggcggacggaggcggcggcggcggcggcgggagcgggagcgggcggcgagtggggagcggggccgggagtggagcagccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggac

SEQ ID NO: 139258 - DNA, 3048 bp, Homo sapiens
  Payload ID: 7296
  Gene Symbol: GNB1
  Gene Name: guanine nucleotide binding protein (G protein), beta polypeptide 1
  ENST ID: ENST00000615252
  CDS Start-End: 548-1270
gagcgcgtggggttttccgaggctgcgggcaggggcccgccgcgcccatcccgatggctggaggcgtctgaggggcggacggaggcggcggcggcggcggcgggagcgggagcgggcggcgagtggggagcggggccgggagtggagcagccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggac

SEQ ID NO: 139259 - DNA, 6706 bp, Homo sapiens
  Payload ID: 7297
  Gene Symbol: GNB1L
  Gene Name: guanine nucleotide binding protein (G protein), beta polypeptide 1-like
  Uniprot ID: Q9BYB4
  ENST ID: ENST00000329517
  CDS Start-End: 238-1221
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaagttgcaggcttgaggtgggagctccctgaggaggccctggtcccccacttagcatcagtgccctcagacccccaccaggcaggatgctcagccccaccctcacacctgctgttgaatgggccaccccgagtgtgggtttcctgggccaggcctcaggagatgataggccccaaccatagctgcgtcgatgtccacatgacccctcaccccgaggaggccaggagctcccaacacacaggttgaggccaggatcaggatcaggaagtaactgaactccctaaagagtgaagcagagaaaggtgcctgtgagggacggcaaggggggcttgcagcgcacagggccaggccagatgtgggatccgggagggcacgcctgcccgcagagggtgcagtggggaaggcgcacagggtgcacctccaggtgagtgctgggcagaaggcacgagagcagcaagggagtgtgacaagcaccgcctcacagtggccaaggccacagtcacagctgcggctgcacacagggtggcccccagggcacaacacagcaagagcaggacttagcagccagagcctcacactgcatgcagccgggcccagcctggccggtcgtctcctcctaaaagcgggtgttgattgggaaagaaccatgaccctgaatattggagtggggcccatgggcagatccagagaagctgggaccacacacgcctgtgtctgcccggattgccggaagagcccctctagctgaaggcccggggtggcctcccttgaggcagttgccctgcaaggccctgccgatgctccttgggacccccacctgggcttctagtcctagaactagactcgagtccagcagacccccaggatgagatacagagggtgaccctgagagtggcaccagcctcctgcaggaccacatggcatttccaggtttccaggcagaaatctgaacatgtgtgggacggatcggaagggtgtgggatccaggtggccggagcaggggtggatcaggggagttcccggaacagacctgccaaacggagggctggactgggcgctgcagcttggggccaggaaggctccagtgccgggctgggggtgggggctggattacagcctgagggtggctgcactgagtgaagtggacatggccagccgccgtggggtacagccgaggagggcttccaaggcctggggatgggggtgttggatttgtcagtgagacctgtgcacccactgcagggggtcccaaggccgtgcctccccaaccccactgtgaggaacatggttgctggggggcccggagtccttgaggagtcctgtgaccacacttctctgttggtcagaggtaccatggggaccgttccatcaaacgggaatgtcagtgctggccgggaaagcggcccctggcccaagcttggagaccacctggctcgggtactggcctggctccgttggacaagggtggccaccaggtgcccaggacctttggagaggggggccctgctgcttttcctcgagtgtcctatagccgccaggatgcgtagggcactccgggaggtattttcatatcactgaggtgtcagggaggggaagggtcctgggtttaggctgcagtgactgcaggtgctgagggagctgtgccctgggtgctcatcacaggctgtcacagtgagggaaggtgtcaggttctgacatccccatgacagcggcagggtaggtggagtgggaattggctttgcagtttccctgcatgcccttgacagccttgccaaaggcacatctgccccgcctcagctcccaccctgagggttctgggcctctaccccttcccctgtttatgtccctgtcatctttggcatcatcactgtagttacaaaactccctacgtcccacagccacgaggtgggtatcccacatgagggcccaggtgtgcatgccagcatgaggttggcgagtggcactgcctgctgatgtcttacatagaggccatgaagagctgtgggcagggtgtacagaccctgagttggcccctggccctcgtgctttcagtcaaaggcacaagcagggtggatggcaggcggctgccccctagcctggccttgagctccctgccccaggccatgtggcgttgagcagtgtccaggcacatcttgttctgaatctcagtgtgcagggatggagtcgggacagcgtgagtcctgcatgcctaacacagccctcacccctccagtgcacaacggggccacgtgcccgcatctgggtggctaggcagatagggccccccttgccaggcagatccagcttctgaggccttatagacgtcctgtggagggcaggcccaggactttcattcacctggctgagctgcctgggagagcagcagaaccggtgctggggtccaagccggccaagagcagtgcagccctcctggtcctgttcctctcttgagctgctccgtggtgtccacagcagagccatgtggctctggacaggtcggcctttgtgtcaacagaacctgggtcgtgatgaatcaccatgcgtctgaccagccttgaaacccccacaacagaagaagaaacggtctcagctccagacatccagcttggaaaagatgcacctgaacattggcattctcttcctagcaaacagccacttcctgtaggctggcaggaacgccaacagagccagcagtgaaggcattaagtggggaggaggggtggcccggaggcagcacgcgaaggtcagcatgcagctcctgggatgaacctgagaggcgactcctggcagcatggctggtcgctgccatcacgcccctggccaacccaccaactgggagaggcagcccttccacatcttcctccataatgctcttgggtagcagtgaggcctctcaagccagagagaacttggtgtttggaaacaacggcggacatttcttgccattttcagtgccaactcaggtaggtgtgttctaccatcctgtgtttttggggtgtttttttttttgagtcagagtctcactctgtcccccaggctggagtgcaatggagcagtctcggctcactgcaacctctgattcccaggttcaagcgattctcctgcctcagcctcccgagaagctcaggaccacccacataggtgcaggccatcatgcccagctaattttttatttttttttatagagaaggagtctcgctatgttgcccaggctggtttcgaactcctgggctcaagcgatcgatcctcccgcctctagcctcccaaagcactagaattataggcctgagccactgcgcccggcccaccatcctgttcttattggaagaatttccatgtgtcgaggcacgggcacaacgtagctggtcctctgctcagggccccacaaggctgcgtcagggtggcagcgcggctgggggctttttctgttcaaatccagattctcgtggctgtgagccccagccctgggcactgtccgcctggtggtgtcttcacagccagcaggggtggccttggggtgttctgtggagtaactttcacggcccagagtgggatcctgagtggctggagccgtatgctccagcatccccagccgctgcctccggtgcaggtggagtgggcccctctgattaccaggagctgtcagaggggcagcaggtcccactccactggccggtgggcagctgtgtgcagggacgcgggtcctggcacgtctgcctggtgaggccctgcctccagtgccaaggggcctcccctctcgacggtgggcgccaccatgtgctgacctctgtgcagccccactttacaaggtaggttcggccagcaccccatccgcgggcgggcagcactcacccagcgttgcgccgccaacagggtccctcttagacaagcagctgtgcctagagccttttccttcctccctgcgtgttacctgcaggccaacagacggccctgggtctgggaccaggagaacctgcctccgcctctggcagtgggtgtccctgcaggcagattgggcttggcacgtagacaccgaggggtcagccgatgccgggagatgatcccgggaagggctccggagcacagcccaggacccgccgccgctgctgggcgctccatgttgacgtgctgtgcgtgtctccactccccaggcaatgatgttcaatcaggtgtttcccacctgtgtctctgccaagaagccacagaacaccctctgcacaaaaggagtgtttgcacaaagaaaaacaaccctccgggggttctttagaaatgcttatactcaattagctagaacttcatgtgaaatcccagcgtggaagacaacaagccggcaccggtgaaaactttgctgtgcacctgccctctaccaagctgccagccccaccagccctgtggtcctaggtgggcacagctgctgcacggtcccccaggcctgcctctcctcggggtctcaaccttcataccagatttgccagcatccccattcccgccttgtgggtggagagtccttgagaccctctgtcactctgtcagcttccccaggtcagcgagctgtggcttggctcccacgcatcagcttttatgggaggcccattaggagctgggcaggagggacagaggggaggccaggcagccactgctgagtgggacgggtagcccagcccatgaggctggccagccctacaggggaggtcccacagcactggccgggaagtccacataggaaagcatcagttgagggatgaagccacggacgatggggacaacggccacagggtgtgctaagctgaggaaattagtaggaggtgctcataagctgttttgttttttggtttgtttgtttgttttttcttttaagagaccagggacagtgggggtctcactctgtcacccaggctggagtgcagtggcatgatcatagcttactgcagcctccaactaataggctcaagtgatcctcctgcctcagcctcccgagtaactcatggcctttaagtgaactgcttccaccatccagctgtgcaggtggcctgggaacagcagcacatctgtcccctgccacctcttgcatgcacacttgacctcctgacttgggctctgaaacctgtaaaatgtggggtgtagagaaatcgagtcatttggcctcatcctggtgccattatctcttgctacattaataaaccacctcaaacag

SEQ ID NO: 139260 - DNA, 1076 bp, Homo sapiens
  Payload ID: 7297
  Gene Symbol: GNB1L
  Gene Name: guanine nucleotide binding protein (G protein), beta polypeptide 1-like
  Uniprot ID: Q9BYB4
  ENST ID: ENST00000405009
  CDS Start-End: 238-876
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgc

SEQ ID NO: 139261 - DNA, 1699 bp, Homo sapiens
  Payload ID: 7297
  Gene Symbol: GNB1L
  Gene Name: guanine nucleotide binding protein (G protein), beta polypeptide 1-like
  Uniprot ID: Q9BYB4
  ENST ID: ENST00000403325
  CDS Start-End: 422-1405
ggcgttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtccgcgccgggggtttgtgggggcacctggagacatttgggccgttctcgcagtctcgggaagccgcgcccgctccttgcctggcctcacggcggccgatctcgttctccactttctaggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaa

SEQ ID NO: 139262 - DNA, 702 bp, Homo sapiens
  Payload ID: 7297
  Gene Symbol: GNB1L
  Gene Name: guanine nucleotide binding protein (G protein), beta polypeptide 1-like
  ENST ID: ENST00000453108
  CDS Start-End: 422-702
ggcgttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtccgcgccgggggtttgtgggggcacctggagacatttgggccgttctcgcagtctcgggaagccgcgcccgctccttgcctggcctcacggcggccgatctcgttctccactttctaggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcaggtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggagggg

SEQ ID NO: 139263 - DNA, 1878 bp, Homo sapiens
  Payload ID: 7298
  Gene Symbol: GNB2
  Gene Name: guanine nucleotide binding protein (G protein), beta polypeptide 2
  Uniprot ID: P62879
  ENST ID: ENST00000303210
  CDS Start-End: 483-1505
tccagtcccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctgg

SEQ ID NO: 139264 - DNA, 1524 bp, Homo sapiens
  Payload ID: 7298
  Gene Symbol: GNB2
  Gene Name: guanine nucleotide binding protein (G protein), beta polypeptide 2
  Uniprot ID: P62879
  ENST ID: ENST00000393924
  CDS Start-End: 129-1151
cggcggcctcgggcctgacgtcagccctgcatcccccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctgg

SEQ ID NO: 139265 - DNA, 1641 bp, Homo sapiens
  Payload ID: 7298
  Gene Symbol: GNB2
  Gene Name: guanine nucleotide binding protein (G protein), beta polypeptide 2
  Uniprot ID: P62879
  ENST ID: ENST00000393926
  CDS Start-End: 246-1268
ctcgagagcggctcccacgggctttctgcgggcgcggcggggcgggcggtccctgcgctggagggagcagcggctcggggctgccttccccgccgctgtcacccccacccgcggcggacggctaatggggcgcagccggaccggggattatccggggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctgg

SEQ ID NO: 139266 - DNA, 1478 bp, Homo sapiens
  Payload ID: 7298
  Gene Symbol: GNB2
  Gene Name: guanine nucleotide binding protein (G protein), beta polypeptide 2
  ENST ID: ENST00000424361
  CDS Start-End: 251-1141
cgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtt

SEQ ID NO: 139267 - DNA, 910 bp, Homo sapiens
  Payload ID: 7298
  Gene Symbol: GNB2
  Gene Name: guanine nucleotide binding protein (G protein), beta polypeptide 2
  ENST ID: ENST00000431068
  CDS Start-End: 214-910
accatcgaagctgggggtgtgtgtggagggtgtgcgccttgtggggtgaatttcaagaggcaccgccccttttaaaattaggtgcttggagggcggtgcctgtgcgggctggggcagaagccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtgg

SEQ ID NO: 139268 - DNA, 1285 bp, Homo sapiens
  Payload ID: 7298
  Gene Symbol: GNB2
  Gene Name: guanine nucleotide binding protein (G protein), beta polypeptide 2
  Uniprot ID: P62879
  ENST ID: ENST00000419828
  CDS Start-End: 199-921
gccgccgccgccgccgccgccgccgccgcctccgccgcggaggaagacagcgccgcccgcgcaccgccagcgacctccgccgcagagtcccaccgccacaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactc

SEQ ID NO: 139269 - DNA, 887 bp, Homo sapiens
  Payload ID: 7298
  Gene Symbol: GNB2
  Gene Name: guanine nucleotide binding protein (G protein), beta polypeptide 2
  ENST ID: ENST00000451587
  CDS Start-End: 134-887
tgaagcaaaccctttgagtacggtttgcgtccacaaagcgtagggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcc

SEQ ID NO: 139270 - DNA, 1146 bp, Homo sapiens
  Payload ID: 7298
  Gene Symbol: GNB2
  Gene Name: guanine nucleotide binding protein (G protein), beta polypeptide 2
  Uniprot ID: P62879
  ENST ID: ENST00000427895
  CDS Start-End: 80-802
cccgcgcaccgccagcgacctccgccgcagagtcccaccgccacaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccat

SEQ ID NO: 139271 - DNA, 1479 bp, Homo sapiens
  Payload ID: 7298
  Gene Symbol: GNB2
  Gene Name: guanine nucleotide binding protein (G protein), beta polypeptide 2
  ENST ID: ENST00000436220
  CDS Start-End: 242-1132
cgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaa

SEQ ID NO: 139272 - DNA, 545 bp, Homo sapiens
  Payload ID: 7298
  Gene Symbol: GNB2
  Gene Name: guanine nucleotide binding protein (G protein), beta polypeptide 2
  ENST ID: ENST00000412215
  CDS Start-End: 90-545
ctttctccccacttccccggcggcctcgggcctgacgtcagccctgcatcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctg

SEQ ID NO: 139273 - DNA, 965 bp, Homo sapiens
  Payload ID: 7299
  Gene Symbol: GNB2L1
  Gene Name: guanine nucleotide binding protein (G protein), beta polypeptide 2-like 1
  ENST ID: ENST00000376817
  CDS Start-End: 104-925
tctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggc

SEQ ID NO: 139274 - DNA, 1150 bp, Homo sapiens
  Payload ID: 7299
  Gene Symbol: GNB2L1
  Gene Name: guanine nucleotide binding protein (G protein), beta polypeptide 2-like 1
  ENST ID: ENST00000511473
  CDS Start-End: 117-236
gcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggtacggactaagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggcttttctgacttttaggtttttttttctt

SEQ ID NO: 139275 - DNA, 697 bp, Homo sapiens
  Payload ID: 7299
  Gene Symbol: GNB2L1
  Gene Name: guanine nucleotide binding protein (G protein), beta polypeptide 2-like 1
  ENST ID: ENST00000513027
  CDS Start-End: 105-697
ctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagtgtggccgggggcctacgggccgggcggggcggtgatgaccccaacatgccatctgagtgtcggtgctgaaatccagaggctgtttctgagctgccgcccggcccaaggctcgtggggagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcc

SEQ ID NO: 139276 - DNA, 685 bp, Homo sapiens
  Payload ID: 7299
  Gene Symbol: GNB2L1
  Gene Name: guanine nucleotide binding protein (G protein), beta polypeptide 2-like 1
  ENST ID: ENST00000507000
  CDS Start-End: 103-685
ggccacaaacacaagagtatgggacacgccagaggaagccacacggattttgcagggagacagtaaggattttgctcatcatcttaaaataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatca

SEQ ID NO: 139277 - DNA, 456 bp, Homo sapiens
  Payload ID: 7299
  Gene Symbol: GNB2L1
  Gene Name: guanine nucleotide binding protein (G protein), beta polypeptide 2-like 1
  ENST ID: ENST00000509535
  CDS Start-End: 1-416
aggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctggactctgtttgctggctacacggacaacctggtgcgagtgtggcaggtgaccattggcacacgctagaagtttatggcagagctttacaaataaaaaaaaaactggc

SEQ ID NO: 139278 - DNA, 1460 bp, Homo sapiens
  Payload ID: 7299
  Gene Symbol: GNB2L1
  Gene Name: guanine nucleotide binding protein (G protein), beta polypeptide 2-like 1
  ENST ID: ENST00000502844
  CDS Start-End: 751-1460
atgaccccaacatgccatctgagtgtcggtgctgaaatccagaggctgtttctgagctgccgcccggcccaaggctcgtggggaggcaggtggactccagaggacctcgtggctcaagtgtcggcctactttttctgcccctggttctccccgtccctatccctgtgttcctgactgcgtttagacgcttcttgtgcttccgctttgctgctacactgttaagaattgtctgacttttgaatcatgtctggctgttaatcgtaaaatttgttgagtgggacaggtttcagtaaaagcatccaatcctgtagcgcctgaagtggcttttccagcattcattactacatttctgtcggccctcagaggtaggcataggaggccccagctactctacagccacaaactgctgtgcatttggttgcagagaagacacaaagtggctgttgagttcgtctgagtttcaggaaagggtgtctgtatttctggcacctaaattaagttctcaggatacaggctgggcgcggtggctcacgcctataatcccagcactttggaaggcagaggcgagtggatcacttgagatcaggagttagagactagcctggccaatggtgaaaccgcatctctagttaaaaaattagccagacgtgctggcaggtgccagctggccaagtaatcccagctacttgggaggctgaggcgggagaattgcttgaacacgggaggtggagtttggagtgagccgagatcatgccactgcactccagcctgggcgacagagcgagactccatctcaagaaaaaaaaaagttatcaggataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgc

SEQ ID NO: 139279 - DNA, 1098 bp, Homo sapiens
  Payload ID: 7299
  Gene Symbol: GNB2L1
  Gene Name: guanine nucleotide binding protein (G protein), beta polypeptide 2-like 1
  ENST ID: ENST00000504325
  CDS Start-End: 90-440
gcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggcttttctgactt

SEQ ID NO: 139280 - DNA, 889 bp, Homo sapiens
  Payload ID: 7299
  Gene Symbol: GNB2L1
  Gene Name: guanine nucleotide binding protein (G protein), beta polypeptide 2-like 1
  ENST ID: ENST00000507756
  CDS Start-End: 1-824
ttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccaggaatacataaccaccacttacaagctggctgttgaaatgagagcggtttcttacagtctacccggcgttgtggcacatgcctactggaggctgagactctgtttgctggctacacggacaacctggtgcgagtgtggcaggtgaccattggcacacgctagaagtttatggcagagctttacaaataaaaaaaaaactggcttttctga

SEQ ID NO: 139281 - DNA, 922 bp, Homo sapiens
  Payload ID: 7299
  Gene Symbol: GNB2L1
  Gene Name: guanine nucleotide binding protein (G protein), beta polypeptide 2-like 1
  ENST ID: ENST00000511900
  CDS Start-End: 81-890
ggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaa

SEQ ID NO: 139282 - DNA, 1100 bp, Homo sapiens
  Payload ID: 7299
  Gene Symbol: GNB2L1
  Gene Name: guanine nucleotide binding protein (G protein), beta polypeptide 2-like 1
  ENST ID: ENST00000510199
  CDS Start-End: 201-1100
cgagtagctgggactacaggcgcccgccaccacgccctaattttttgtatttttagtagagacggggtttcaccgtgttagccaggatggtctcgatctcctgacctcgtgatccgcccgcctcggcctcccaaagtgctgggattacaggcgtgagccaccgtgcccggcctctccttgggactcttaccttgtatggaatggaagtggtgcctctggggtcccagacacgggagagaggaagcagcccaggggctgggagaagtggtgagacccagaagaacggtggacccagtcaggaagggtcctgccagcagggcgtgggccagcctcggggtcttccccaaaaggcaggtaggggcctccagcaagcttcccacctccgtgaggctggagaagaggccccctggatgagaaggaagaggccggcaggtccggcgggcgcaggcacagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccaca

SEQ ID NO: 139283 - DNA, 587 bp, Homo sapiens
  Payload ID: 7299
  Gene Symbol: GNB2L1
  Gene Name: guanine nucleotide binding protein (G protein), beta polypeptide 2-like 1
  ENST ID: ENST00000503081
  CDS Start-End: 107-587
ctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaaattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctga

SEQ ID NO: 139284 - DNA, 888 bp, Homo sapiens
  Payload ID: 7299
  Gene Symbol: GNB2L1
  Gene Name: guanine nucleotide binding protein (G protein), beta polypeptide 2-like 1
  ENST ID: ENST00000509148
  CDS Start-End: 1-250
ttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccaggtaagtgggtctgtcctctcaggtgattctgcttccagttaattttctccctctcattctgttagtatatctagtctgtcagacacaagagcagtgtccttggcataaagtgaaatgacaagccaggttgatgaggatgccctcgtttgccatgccagtgaatgtgtttctgcatcagagggaagactgatgtggaacgcagtggctgtcagccttcaattaataccttaattaatctgaccagttttcaaatgtctggagccttatcaccagctgtttcttcctcaaggaatacataaccaccacttacaagctggctgttgaaatgagagcggtttcttacagtctacccggcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccacttgggctgaatctagtgagactgcagaatttatgccagcctgacctgtcactgtcatttcttccctgcagactctgtttgctggctacacggacaacctggtgcgagtgtggcaggtgaccattggcacacgctagaagtttatggcagagctttacaaataaaaaaaaaactggcttttctga

SEQ ID NO: 139285 - DNA, 1208 bp, Homo sapiens
  Payload ID: 7299
  Gene Symbol: GNB2L1
  Gene Name: guanine nucleotide binding protein (G protein), beta polypeptide 2-like 1
  ENST ID: ENST00000508682
  CDS Start-End: 103-546
ctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggctggagtgcagtagtgcgatctcggctcactgcaagctctgcttcccgggttcacgccattctcctgcctcagcctcccgagtcgctgggactacaggcgcctgccatcaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggc

SEQ ID NO: 139286 - DNA, 1058 bp, Homo sapiens
  Payload ID: 7299
  Gene Symbol: GNB2L1
  Gene Name: guanine nucleotide binding protein (G protein), beta polypeptide 2-like 1
  ENST ID: ENST00000512968
  CDS Start-End: 94-1058
caaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacattgtctctggatctcgagataaaaccatcaagctatggaataccctgggtgtgtgcaaatacactgtccagtctcattctgtcgcccaggctggagtgcagtagtgcgatctcggctcactgcaagctctgcttcccgggttcacgccattctcctgcctcagcctcccgagtcgctgggactacaggcgcctgccatcaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacgga

SEQ ID NO: 139287 - DNA, 388 bp, Homo sapiens
  Payload ID: 7299
  Gene Symbol: GNB2L1
  Gene Name: guanine nucleotide binding protein (G protein), beta polypeptide 2-like 1
  ENST ID: ENST00000504726
  CDS Start-End: 92-352
aggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaac

SEQ ID NO: 139288 - DNA, 825 bp, Homo sapiens
  Payload ID: 7299
  Gene Symbol: GNB2L1
  Gene Name: guanine nucleotide binding protein (G protein), beta polypeptide 2-like 1
  ENST ID: ENST00000511566
  CDS Start-End: 81-782
ggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaagactctgtttgctggctacacggacaacctggtgcgagtgtggcaggtgaccattggcacacgctagaagtttatggcagagctttacaaataaaaaaaaaactggcttt

SEQ ID NO: 139289 - DNA, 843 bp, Homo sapiens
  Payload ID: 7299
  Gene Symbol: GNB2L1
  Gene Name: guanine nucleotide binding protein (G protein), beta polypeptide 2-like 1
  ENST ID: ENST00000503494
  CDS Start-End: 82-543
aggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccagtctcattctgtcgcccaggctggagtgcagtagtgcgatctcggctcactgcaagctctgcttcccgggttcacgccattctcctgcctcagcctcccgagtcgctgggactacaggcgcctgccatcaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggagg

SEQ ID NO: 139290 - DNA, 559 bp, Homo sapiens
  Payload ID: 7299
  Gene Symbol: GNB2L1
  Gene Name: guanine nucleotide binding protein (G protein), beta polypeptide 2-like 1
  ENST ID: ENST00000506312
  CDS Start-End: 103-318
ctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattgg

SEQ ID NO: 139291 - DNA, 791 bp, Homo sapiens
  Payload ID: 7299
  Gene Symbol: GNB2L1
  Gene Name: guanine nucleotide binding protein (G protein), beta polypeptide 2-like 1
  ENST ID: ENST00000514455
  CDS Start-End: 437-742
ctcctgggtaatttttgtatgttagtagagaggattttaccatgttggccaggctggtcttgaactcctgacctcaggtgatccgcccacctcggcttcccaaagtgctgggattacaggcatgagccaccgcacccagcctaaagttggtttcttgaagcagttgatgagattgggatcctggttttcagaaatgattggagtgatttatgtaagttgggaggggttttttgatggggttggtaaggtcttacgttaaaggaaaggtatacagagataaatattggtacttgagtcattagctttcaaagaagcctggggtaatggaggaaaggtaagaattgattctgacagaatcttgagatgggcagaattaacatctggaagaggtcacagtgtcctgatttaccttacctgtgtccaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggcttttctgac

SEQ ID NO: 139292 - DNA, 1403 bp, Homo sapiens
  Payload ID: 7299
  Gene Symbol: GNB2L1
  Gene Name: guanine nucleotide binding protein (G protein), beta polypeptide 2-like 1
  Uniprot ID: P63244
  ENST ID: ENST00000512805
  CDS Start-End: 410-1363
ataggggcggggaagcagcccggcggtcctcatgggaatgtgccgtacacttcacctctttcgcttctcgctctacatcatccctgagaagcctttttaaacacttgaatgtgcttgtttcagagtgtatttgtaaagtgcagtcagattttgttgtacggaagacgggactgtgatgccttgcaatttccctctgccttttgcattacatggcgccgccatcttgagcagaaatgtatcatggggctcgccattttgcatggtcgagcgggtatttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggc

SEQ ID NO: 139293 - DNA, 643 bp, Homo sapiens
  Payload ID: 7299
  Gene Symbol: GNB2L1
  Gene Name: guanine nucleotide binding protein (G protein), beta polypeptide 2-like 1
  ENST ID: ENST00000502905
  CDS Start-End: 1-595
ggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggcttttctga

SEQ ID NO: 139294 - DNA, 990 bp, Homo sapiens
  Payload ID: 7299
  Gene Symbol: GNB2L1
  Gene Name: guanine nucleotide binding protein (G protein), beta polypeptide 2-like 1
  ENST ID: ENST00000504128
  CDS Start-End: 1-742
gggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccaggaatacataaccaccacttacaagctggctgttgaaatgagagcggtttcttacagtctacccggcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccacttgggctgaatctagtgagactgcagaatttatgccagcctgacctgtcactgtcatttcttccctgcagactctgtttgctggctacacggacaacctggtgcgagtgtggcaggtgaccattggcacacgctagaagtttatggcagagctttacaaataaaaaaaaaactggc

SEQ ID NO: 139295 - DNA, 564 bp, Homo sapiens
  Payload ID: 7299
  Gene Symbol: GNB2L1
  Gene Name: guanine nucleotide binding protein (G protein), beta polypeptide 2-like 1
  ENST ID: ENST00000626067
  CDS Start-End: 103-564
ctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccagtctcattctgtcgcccaggctggagtgcagtag

SEQ ID NO: 139296 - DNA, 1923 bp, Homo sapiens
  Payload ID: 7300
  Gene Symbol: GNB3
  Gene Name: guanine nucleotide binding protein (G protein), beta polypeptide 3
  Uniprot ID: P16520
  ENST ID: ENST00000229264
  CDS Start-End: 406-1428
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 139297 - DNA, 1110 bp, Homo sapiens
  Payload ID: 7300
  Gene Symbol: GNB3
  Gene Name: guanine nucleotide binding protein (G protein), beta polypeptide 3
  ENST ID: ENST00000435982
  CDS Start-End: 91-1110
agtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccactgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactga

SEQ ID NO: 139298 - DNA, 962 bp, Homo sapiens
  Payload ID: 7300
  Gene Symbol: GNB3
  Gene Name: guanine nucleotide binding protein (G protein), beta polypeptide 3
  ENST ID: ENST00000541978
  CDS Start-End: 265-962
cttccccccacccctgccagctgatttcatttgcctgacgttgtggttggctctacccttccctgtcaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctg

SEQ ID NO: 139299 - DNA, 761 bp, Homo sapiens
  Payload ID: 7300
  Gene Symbol: GNB3
  Gene Name: guanine nucleotide binding protein (G protein), beta polypeptide 3
  ENST ID: ENST00000541257
  CDS Start-End: 66-761
tccccaccaccctgagctgaggagcacagtttgaggagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccactgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgt

SEQ ID NO: 139300 - DNA, 590 bp, Homo sapiens
  Payload ID: 7300
  Gene Symbol: GNB3
  Gene Name: guanine nucleotide binding protein (G protein), beta polypeptide 3
  ENST ID: ENST00000539127
  CDS Start-End: 70-180
cggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagcgggacctgctctgagccaggcaccatattggatgcgaaagatgcggacacggttcctattctcatccgtagaacaagagtgaccacagccccctcccagggccttgaagatgaagaagcgatagtactttctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgag

SEQ ID NO: 139301 - DNA, 796 bp, Homo sapiens
  Payload ID: 7300
  Gene Symbol: GNB3
  Gene Name: guanine nucleotide binding protein (G protein), beta polypeptide 3
  ENST ID: ENST00000537035
  CDS Start-End: 3-796
ccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtggg

SEQ ID NO: 139302 - DNA, 6434 bp, Homo sapiens
  Payload ID: 7301
  Gene Symbol: GNB4
  Gene Name: guanine nucleotide binding protein (G protein), beta polypeptide 4
  Uniprot ID: Q9HAV0
  ENST ID: ENST00000232564
  CDS Start-End: 288-1310
ccccggcacgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactctgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaaaaaaggcaaaggcgccttctgagatcaaaaggaccagtgtattaatttgaggggttgggttattttaaccttggtgaattgttgtgtgtactcagagtgtattttctttgtgtagaacagaatgtacacattatagcagctcgccattgtgtttgcattttttaagaagtacatttttaactttgtatacacaagaaatgtcatatttttgagttttgtaatggaagaaccaggcacagaaacagacagaaatgatactgtatgtgtgtgtatttatgtctgaagaaagtccccttgaattctgatatctctttgaatctaagagatcctgatagcttcatgtttaagagcattgacaggtggggcacctctgaggggagttcattgtttctcatgcatcatttgccatatactattaatcaaagtgcttgctttcagtcctttgaggggacagataatctgaaggccagagattagagatttcactgatattttggacatacataagaaacatcattataattaataaaaagtaggtaatagcatataaatggttcttgacattttaaaagcctggttatgatcagttgacactttgagtacccccctaaatagctggactttccttttcatttcatatttggaactaagtttgtagcgtatactcatctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaatacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggtataataatgtgtctcttactagaagtcccccacgaccaagttaaagatacttttcctgttggattctcttttacaaataagtctaaatgactgataatagaagattgttagtcttgcttgatggtaaagtcttggattattctgatatatagacgtgcattgttttgtaacttagttacttttcagataggtctgtgttaacttttgaacatgtgtaacttaacctaaatactcccaaactttacctctaaatttttgtttttatgttgtgaatgtgctaatatgtgcatcaactgtaaagatgtatcagttttattaaaatcagttgacaattagaataataaagtggataaaggcaaattaagatataggaccaaaacagaatattgtagatggcagttatgaatgtatatttatattttgattaagatttctattaactttttggctgggcagagtggcttacacctataatcccagcaatttgggaggccaaggtgggcagatcacttgaggtcaggagttcgcgaccagcctacccaacatggtgaaaccccatctcttctaaaaatacaaacattagccgggcgtggtggcacattcctgtaatcccagctactcgggaggctgaggcaggagattcgcctgaacccgggaggcagaggttgcagtgagccgagattgtgccactgcactccagcctaggcgacagagtgagactccatctcaaattggaaaaaaaaaaaattatatgaacttttgctattaatgtttatttgtaggctatttatatcacttcataaagaacagttctttgagaaaagaataaaggaatgtattcatttccagaaaaagagggttggggaaagtttgccatgtaggttagtcagaagaaagcaattctattatgcataaaaataaccttaaatatgtaagagagtatctcctctacttaaaagttattatagtagtcacaggcatacagaccacaggaattctatggtcttaacatattttaaaattacatttattttaatgttcttaaagtttatgaagaggagtttaaagcaattcccataattaaatatttactcggcaactaaaaactatttaacacttgtggttaattatacacataaacaaatggcgacagagtagcctcactaccacaattacttcatggttacacctttgctttctaataataggggctccagttgctaaatatatttgtttacttacagtttaagttgagctgattgttgaattctgttattgttcctgaattcaatgagtatataatttgtagagatgttgaatagtttggatcttagtttttaaggctgaaaaatctggctggatttagtttttaaaaatttgcatcatcaagaatattgcagttaatgttcctttttttttttttttaaagacagagtctcactctgtcacccaggctggagtgtacagtggtgtgattttggctcattgcaacctcaacctctgcctcctgggttcaagcaattcttgtgcctcagcctcccaagtagctgggactataggcatgtgccaccatgcccggctaatttttgtatttttagtagagatggggtttcaccatcttggccagtctgatctcgtactcctggcctcaagtgatccaccagcctcagcctcccaaagtgctgggattacagacgtgagccaccgtgcccagccaggtttccttctttaccttctaagaaacatttaaacataatgtgcctgagaaggttaatttgttgactctgtagcatgtcaagaagagtagttttttgagatctggcaagaatattttagagatacatattcttttctaagtatgttatcaccctgtggtgttgagcatatcgtcccaaaaacctgcttcagcaagcagttcttggccaggcatggtggctcacacctgtaatcccagcactttgggaggccgaggcaggtggatcacgaggtcaggagttcaagaccagcctggccaagatggtgaaaccccatctctactaaaaatacaaaaattagccgggcgtggaggtgggcgcctgtcagctactcgtgaggctgaggcagagaattacttgaactcaggaggtggaggttttggtgagctgagatggcgccactgcactccaacccgagcgacagagcaagattccgtcccaaaaagaaaaagcagtttttgccatcagcaaggatatctcctccactttaatggacaggcctcatttttggcagctatgctgtttgagatgtagactgaatatccaaggttcctccctagctcaagtttttacttgtgattacacacaccacattgaattccgtcttcagaggcaaagatttgggcttcatatctcaacagcaaaagggcctgttcagcaattcccttcattttagactcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttaggaaaactggttaaacaatcccccatttgggcctgtcatcattttaatagtgacgatgttctttctgaaatcttcagggtcggagtcaggctgaatttttttaaaaattaaatattatgttcaaattctttcctttttgccattgtgaaaaagcaaaattttaaatgatttctcctgttagaatttttaaaaatacccacaggttggaccatctttcttatgggttgcacaatgaatttatattttaaattagattaagtagaatgtgaagtacatttcagatttactagttttctttccattgttcattttgggttgcctcagattcagtgtatattttaaaatattggttacataataggtactcaatgaaatggtttatagtagaatatctaagctagcactttattttaaaaagtaacttattaattaatcacacattgatggtacaccttgtatttagcaaatgtttgcatgttgataaaatctcctatgtcttctttcttaaatccagttgctgattttgtaaaatacagttgtgataaagcagcattacgggggggaaaaagctatattccaactggtgttaaatgtattcaacaaaatcttacatcatacagtatttatttcttaattaatagaacttcagtgatatacttggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtggctttatgaaatgttgtgaattgatactgtaatcaataaagtgcttttaaccag

SEQ ID NO: 139303 - DNA, 1360 bp, Homo sapiens
  Payload ID: 7301
  Gene Symbol: GNB4
  Gene Name: guanine nucleotide binding protein (G protein), beta polypeptide 4
  Uniprot ID: Q9HAV0
  ENST ID: ENST00000468623
  CDS Start-End: 212-1234
agctgccacgcgggaactggccccacgaccgccggcgcaggcacttcccgggcggtccagaccgctcgccccggggagcgaggaacggtcggcggtccaagtcctgcagacccccctggtttctcgtcactccccgaggcctccttccaggaactcagagcacgagcccctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactctgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaac

SEQ ID NO: 139304 - DNA, 937 bp, Homo sapiens
  Payload ID: 7301
  Gene Symbol: GNB4
  Gene Name: guanine nucleotide binding protein (G protein), beta polypeptide 4
  ENST ID: ENST00000466899
  CDS Start-End: 1-496
attaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagtgtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaaaaaaggcaaaggcgccttctgagatcaaaaggaccagtgtattaatttgaggggttgggttattttaaccttggtgaattgttgtgtgtactcagagtgtattttctttgtgtagaacagaatgtacacattatagcagctcgccattgtgtttgcattttttaagaagtacatttttaactttgtatacacaag

SEQ ID NO: 139305 - DNA, 571 bp, Homo sapiens
  Payload ID: 7301
  Gene Symbol: GNB4
  Gene Name: guanine nucleotide binding protein (G protein), beta polypeptide 4
  ENST ID: ENST00000497513
  CDS Start-End: 333-571
ctgggtgtggccggcggctctggtctcggctgtgagctgcgctctccacgccggctccgcgctccaggggctgctgagcgcccagcggacaccggcagcgcgcggtcgacgcgggcctgagctccctccagagatggatacctgccatgtagcccaggctggtcttgaactcctggcctcaagtgatctgcccacctcagcctcccaaagtgctgggattatgggcatgagccactgcgcctggcctatcctgcctttgtgccaggcagtcctcctcatgtgtattacagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactctgtgggtcgaatacaaatgcgaacaagacgtacactgaggggccacctagctaaaatctatgctatgcattggggatacgattccaggctgctagtcagtgcttctcaagatggaaaattaat

SEQ ID NO: 139306 - DNA, 1491 bp, Homo sapiens
  Payload ID: 7302
  Gene Symbol: GNG10
  Gene Name: guanine nucleotide binding protein (G protein), gamma 10
  Uniprot ID: P50151
  ENST ID: ENST00000374293
  CDS Start-End: 301-507
gattcctgctcatcctaggggcgccagcttcgctggaggacgccgcgctctgcgggtccccgcctcggttccaggcccagctgcaggtgccacccaggtttcaggcgctgaggagcggagagcactgccagctcgctggggtccccgctgtctctggcaagcggctccgcgccgggtgggctggggcggcggggcgggcgcagctgcttccccgccccggggcggcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatcatttttctatgacagcaa

SEQ ID NO: 139307 - DNA, 3055 bp, Homo sapiens
  Payload ID: 7303
  Gene Symbol: GNG11
  Gene Name: guanine nucleotide binding protein (G protein), gamma 11
  Uniprot ID: P61952
  ENST ID: ENST00000248564
  CDS Start-End: 440-661
gcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaagatgagtgttggtgatttaagaagacacttttcatgcattaacttttatatttctccccgtaatcttttgggtgtggagtatgattgggtttggaatatgattcagaaggttaggtggttcgacagatcacatctccaaaccctgcgtcaatggtttagagtgctgagttctgacctctggaacgtgtttgatctaaccttaactattaagaaactgagcaggtagaattcctataacattgacagaagtcagattatctgagtcaggaacaaggccaagccacatctatgttagtacttccctagtttatcatcatttagatcttcttaatagtgttcctgtagtagtagccttgaagaaaatactgagttggggttcaggaagagtgccctgcctctctgccgtgtagtggccaggccagccctggctttgagagccagtacttattcctgcacagagctacatctcccatgtgctctccaggtcttgggcatggcactactccagttctgtggcattggtgcagacacttggacctctgcactcatgcttgccagcattttccagcaggcctgggccaaacatgcctttttttcttctcctccaaaggaaccagtgaatctttgcccactttaaagattagttggtctttttcttactgatttgtaggaattcttcatatattctggccatttattcgtgtttggtgatatgtgttgcgaataccttctcccagtctgtggcttaccttttcacagtgaccttcccttcagtggttttatcctgcagggcaacacgtcagagtataactcctgctcaagttcataacaaaggtacctgaagcccaaacctcacaaaaagggacctttctttctcaccttgagcattctcccgcttcttctccgtcttttgggtcaaaattgctccaagtttgagccaaaagaaaaacgtggaaaaacccttgctggttagctctagctcaaatggacttagtcattaacttgacctgcaattttcaatgtggcaccagaagccaatgtttctccttgactagctcttttctcccacttacacatgtaggtataccttactatcaagcgagagaggcgcctgtaacctgtagcagctttctaaagtatatcagcatcctcgttctgaaattcctttcctttccctctctgggaaagaacagaataccccaggcttttgaaaaatagtttacacagaccaaaagcagaaactatttccttcagtttcctgacactgtccaagtgatgacatcaattggcattactgagagcccagggataattttagcccaaaactactactcctaggaaggagtagtatgatctactactcttaggaaggatttaggaatagtaaaggtgtatttcttccaaacagcatagaactattagtactattagtcatttaacatttaacatggcatgggattttagagctttggtgcctgtaaagttttacttctattagctgtttcatttctttgcacttataaagttttcttctgttgcctatgaaagcaaacatttattccggttactggcaaggcagtttaaatcacctgcttctttcatgaaaggccaagacaatacatttattccctaacttgttgggagttgcgattacaagtctatatcctgatttctattagcacattcagctatccatttgtgtacactcccaagtcctagcttttgctcttcatgtctctttcaaccatatgatcaatcagttggacgacttctggtttttcctgaataaatatctaatcttataggtgcttctattaaatataattctgtttctttttcttaccatttatcattataacccagccaacatgtagaagtgcaataaaaatattttaattttcaactgttcaactgctaaaattattagcttgtaattaaaaaagaaaaaatacatccactatatatttagatatattgtaaatgtaacctttggtgactgataatttgttaagtagaatttaaattatgtatccaatttattcaaagtgtatagttgtgtaattatttactatttgattaaaaatagttatcatgca

SEQ ID NO: 139308 - DNA, 4404 bp, Homo sapiens
  Payload ID: 7304
  Gene Symbol: GNG12
  Gene Name: guanine nucleotide binding protein (G protein), gamma 12
  Uniprot ID: Q9UBI6
  ENST ID: ENST00000370982
  CDS Start-End: 201-419
agcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggataggcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagaccatttctcttc

SEQ ID NO: 139309 - DNA, 984 bp, Homo sapiens
  Payload ID: 7305
  Gene Symbol: GNG13
  Gene Name: guanine nucleotide binding protein (G protein), gamma 13
  Uniprot ID: Q9P2W3
  ENST ID: ENST00000248150
  CDS Start-End: 103-306
cttggccctcgctctcactcgcggtcgcctggccgttgtcattgtccctccgctgtcaccttttcaagccccaggctggctgcttcagaagcccctgaccccatggaggagtgggacgtgccacagatgaagaaagaggtggagagcctcaagtaccagctggccttccagcgggagatggcgtccaagaccatccccgagctgctgaagtggatcgaggacgggatccccaaggaccccttcctgaaccccgacctgatgaagaacaacccatgggtggaaaagggcaaatgcaccatcctgtgagccccgcacccggcccctctcacaccatcctgtgagaccacgcccggccccactcccaccatcttgtaagactgtgcccagccccactcactccatcctgtgagtcccactcccagccccactcccaccatcctgtgagcccatgcccggccccactcacaccaacctgtgagccccactcccggccccactcactccatcttgtaagactatgcccagccccattcactccatcctgtgagtcccactcccagccccactcccaccatcctgtgagccccacttccagccccactcccaccatcctgtgagccccactcccagccccactcccaccatcctgtgagccccactcccggccccactcactccatcctgtgagccccactcccagccccactcacaccaacctgtgagccccactcccggccccactcacaacatcttgtaagactgtgcccggccccattcactccatcctgtgagaccacgcccggccccactcactctatcctgtgagaccacgcctggccccactcccaccatcctgtgagccccactcctggccccactcacaccatcctatgagcccacgcccggccccactcccaccatcctgtgaaccccactccactcgcacgtgattacagtctgtaaaggtgtgactttataaagaca

SEQ ID NO: 139310 - DNA, 3729 bp, Homo sapiens
  Payload ID: 7306
  Gene Symbol: GNG2
  Gene Name: guanine nucleotide binding protein (G protein), gamma 2
  Uniprot ID: P59768
  ENST ID: ENST00000335281
  CDS Start-End: 407-622
aacaaagggagaagggggattaaagtcaaatcactgtcagcagcccaggagcagacaaaaccaccagagtaagccctgaaatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattc

SEQ ID NO: 139311 - DNA, 479 bp, Homo sapiens
  Payload ID: 7306
  Gene Symbol: GNG2
  Gene Name: guanine nucleotide binding protein (G protein), gamma 2
  ENST ID: ENST00000553560
  CDS Start-End: 324-479
acaaacgcccgttggcatcaagacaggcctgtgaactggcatccccaggcaggctgcagactgggagggtgggagtgagcatgcagctgaccccaccatgaggcacagggcgtcgccttctcccctcagcacagaggagaggtgacgaatgccacttggtctctgcagcgtctgtagagggaagtctgtaagcgggagtgtcaaccccaattggcagattctctgacacttcaagtctgcaaaggaaaagcagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaagagcgccctctgctggtcagttctcagaaggcgccacatcatcgcgtctttcgtctgcagatgctctttg

SEQ ID NO: 139312 - DNA, 573 bp, Homo sapiens
  Payload ID: 7306
  Gene Symbol: GNG2
  Gene Name: guanine nucleotide binding protein (G protein), gamma 2
  ENST ID: ENST00000557376
  CDS Start-End: 151-483
atgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagacaagaatcccagagcatagaaaagtcacacagctaattaagtgttggagcccggatttgaacccagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcat

SEQ ID NO: 139313 - DNA, 522 bp, Homo sapiens
  Payload ID: 7306
  Gene Symbol: GNG2
  Gene Name: guanine nucleotide binding protein (G protein), gamma 2
  ENST ID: ENST00000556522
  CDS Start-End: 108-221
atgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaag

SEQ ID NO: 139314 - DNA, 908 bp, Homo sapiens
  Payload ID: 7306
  Gene Symbol: GNG2
  Gene Name: guanine nucleotide binding protein (G protein), gamma 2
  Uniprot ID: P59768
  ENST ID: ENST00000555472
  CDS Start-End: 340-555
actcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagggatgatactgtgaagtgttcaggaatgaagtctcgtgatgtctgctacctagtttcaaatggcaggagagacagagggatggggaagcaaaagtgaccattgttaactctaggtggttgtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaa

SEQ ID NO: 139315 - DNA, 2125 bp, Homo sapiens
  Payload ID: 7306
  Gene Symbol: GNG2
  Gene Name: guanine nucleotide binding protein (G protein), gamma 2
  Uniprot ID: P59768
  ENST ID: ENST00000556766
  CDS Start-End: 216-431
acaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatg

SEQ ID NO: 139316 - DNA, 577 bp, Homo sapiens
  Payload ID: 7306
  Gene Symbol: GNG2
  Gene Name: guanine nucleotide binding protein (G protein), gamma 2
  ENST ID: ENST00000553432
  CDS Start-End: 113-421
agagcatgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccct

SEQ ID NO: 139317 - DNA, 430 bp, Homo sapiens
  Payload ID: 7306
  Gene Symbol: GNG2
  Gene Name: guanine nucleotide binding protein (G protein), gamma 2
  ENST ID: ENST00000554875
  CDS Start-End: 125-310
ttaactctaggtggttgaagatattgaaattgcaatcatcttgtttttgggggaatggagtcattccatattggctcttgagtatgtctgccaccactctgattctagctggaggctgccagaaatgactgtgccattgaatggagttattaggcaacataaaacggacaagccagaccaagtgtttctgaaagatctatccagcactccgatggccagcaacaacaccgccagcatagcacaagccaggaagctggtagagcagcttaagatggaagccaatatcgacaggataaaggaagttcactgacccctggtctacagcgatggttctcagctcatctgtgcgttcccaacacccagagagctctataaaaggaccaattaccgaaccacacccaaaccaattaaattagaatctcctggggta

SEQ ID NO: 139318 - DNA, 3424 bp, Homo sapiens
  Payload ID: 7306
  Gene Symbol: GNG2
  Gene Name: guanine nucleotide binding protein (G protein), gamma 2
  Uniprot ID: P59768
  ENST ID: ENST00000556752
  CDS Start-End: 96-311
gtttttctctctgctttctcaacagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattcatttca

SEQ ID NO: 139319 - DNA, 569 bp, Homo sapiens
  Payload ID: 7306
  Gene Symbol: GNG2
  Gene Name: guanine nucleotide binding protein (G protein), gamma 2
  Uniprot ID: P59768
  ENST ID: ENST00000554736
  CDS Start-End: 138-353
agtgtcttcctccctcagcttgtgcagctgctttcaggataacctcagacacagctatcatttgccaccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcc

SEQ ID NO: 139320 - DNA, 1294 bp, Homo sapiens
  Payload ID: 7306
  Gene Symbol: GNG2
  Gene Name: guanine nucleotide binding protein (G protein), gamma 2
  Uniprot ID: P59768
  ENST ID: ENST00000615906
  CDS Start-End: 728-943
ggcgtcgccttctcccctcagcacagaggagaggtgacgaatgccacttggtctctgcagcgtctgtagagggaagtctgtaagcgggagtgtcaaccccaattggcagattctctgacacttcaagtctgcaaaggaaaagcaggtacgactcctttatcttggacagtcatcttgtaatgcaggcctgtgggatacaaaggagaccagggaggttatgtgagctctgccaaatctattactactccaggggaaaataaaaccaaattcttgggctagtggaattactgtaggagaaatccagtatgattccatgtgaagaaccaatagcacccttaaattaaagccagatctgccagtgagcctcaggctttaggaactgaagaggtcataaaattgctgttatgtatgtgaaaacggccaaatataccatagaccccagattaggatcagtctggtgcctctgaaaatgtgaattgagaagaactgaaagaaaatctttccctggggagactgcagccgaaacacccttctgacgaatgtgctgacctaatctaagcctcaatttccttcaacaagggatgcatcgctcacttcccttgagttgtgagaatgaaacaagataatgcgttaaagcccttggcccagttcctggcatgtggcgagctcttggtccataagcaaatcttcgtattagttgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggt

SEQ ID NO: 139321 - DNA, 882 bp, Homo sapiens
  Payload ID: 7307
  Gene Symbol: GNG3
  Gene Name: guanine nucleotide binding protein (G protein), gamma 3
  Uniprot ID: P63215
  ENST ID: ENST00000294117
  CDS Start-End: 260-487
ccaggatctgagcagctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctca

SEQ ID NO: 139322 - DNA, 1595 bp, Homo sapiens; identical to SEQ ID NO: 138313
  Payload ID: 7308
  Gene Symbol: GNG4
  Gene Name: guanine nucleotide binding protein (G protein), gamma 4
  Uniprot ID: P50150
  ENST ID: ENST00000366597
  CDS Start-End: 91-318

SEQ ID NO: 139323 - DNA, 1721 bp, Homo sapiens; identical to SEQ ID NO: 138309
  Payload ID: 7308
  Gene Symbol: GNG4
  Gene Name: guanine nucleotide binding protein (G protein), gamma 4
  Uniprot ID: P50150
  ENST ID: ENST00000366598
  CDS Start-End: 217-444

SEQ ID NO: 139324 - DNA, 5104 bp, Homo sapiens; identical to SEQ ID NO: 138311
  Payload ID: 7308
  Gene Symbol: GNG4
  Gene Name: guanine nucleotide binding protein (G protein), gamma 4
  Uniprot ID: P50150
  ENST ID: ENST00000391854
  CDS Start-End: 455-682

SEQ ID NO: 139325 - DNA, 4978 bp, Homo sapiens; identical to SEQ ID NO: 138310
  Payload ID: 7308
  Gene Symbol: GNG4
  Gene Name: guanine nucleotide binding protein (G protein), gamma 4
  Uniprot ID: P50150
  ENST ID: ENST00000450593
  CDS Start-End: 329-556

SEQ ID NO: 139326 - DNA, 684 bp, Homo sapiens; identical to SEQ ID NO: 138312
  Payload ID: 7308
  Gene Symbol: GNG4
  Gene Name: guanine nucleotide binding protein (G protein), gamma 4
  Uniprot ID: P50150
  ENST ID: ENST00000484517
  CDS Start-End: 102-329

SEQ ID NO: 139327 - DNA, 920 bp, Homo sapiens
  Payload ID: 7309
  Gene Symbol: GNG5
  Gene Name: guanine nucleotide binding protein (G protein), gamma 5
  Uniprot ID: P63218
  ENST ID: ENST00000370641
  CDS Start-End: 475-681
cttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatcggcccctctggagaggaaaagaaaacttaagagtcgggtcgcgctagcctccagcagccgccgcgcccaccgactgctccgccccttctcctccccctcctccaggctcgcgctcggggccgggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaa

SEQ ID NO: 139328 - DNA, 790 bp, Homo sapiens
  Payload ID: 7309
  Gene Symbol: GNG5
  Gene Name: guanine nucleotide binding protein (G protein), gamma 5
  Uniprot ID: P63218
  ENST ID: ENST00000370645
  CDS Start-End: 341-547
cttcccacaaactgggaggaaaactgagacctcctggtcacccgccgccgggccttttagaaactcccacaagctctgccttccctccctggtcctcttcagaccccctcttagttcttcgcggctaacggctcgcgctcggggccgggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 139329 - DNA, 4208 bp, Homo sapiens
  Payload ID: 7310
  Gene Symbol: GNG7
  Gene Name: guanine nucleotide binding protein (G protein), gamma 7
  Uniprot ID: O60262
  ENST ID: ENST00000382159
  CDS Start-End: 199-405
gcgggccggggcggagggttcggctgcgcggcggggctgaggcggccgcggggcccgagcgcagggagtggagcttggtttcgggatctcggtgctgcagacggcgagacctcctgcacagggtgtacagcaagctgtgattcctgggaaaactaaaaaagctctctgaacaacggggcccagagctgatggcagacaatgtcagccactaacaacatagcccaggcccggaagctggtggaacagctacgcatagaagccgggattgagcgcatcaaggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatggaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaactcggattgtgatggttgaacccgtcgctaaactgcacgatcctgcaatgaatgcacgatggagtgtgggggtctggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggattttttttttttttctttttttgagatggagtttcattcttgttacccaggctggagtgcagctgcatgatttcagctcaccgcaacctctgcctccccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtgtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggggaggcttctgaaagatgactgcgtcctcctctgcggcacggacgggagcaggtgcagccacatcttccagggcctgccggcatcacctgcggccacacctgagatggaccccacgcagccctgatcgcaggaggcctggccgccccgaccccctccacggggctggcctagaagcaagtagtagaataaaactagcctagtcctgtccctccggccccagtggagacaggcgtctaagaacccgtgccgagagggttcctggacggccgcccaggtcctccgtgcaggcccgtgaggcggggatccctgcttggctcacttcctgagctggtgactgccagggttcccacctcgccaaggctagagggctccgggtgtgtgtgcaggtgtcgggggagtgacctccactcctcaacctcgggcagctcccacaggccacagccgggctccccacccccggcacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacaagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagacgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatctcccggaccccagggaggtggccattgccagaagcctgtgggtttctttctagcttgggggattaaaaaaaaaattctccacttttttttttcttgagtagacttcagtgaccacactgtggaaaatacctttgcagacgtggcacccgagtgcacacaccgaccgccacatgtgcttttctgccgggaatccctggggtgaacgcatgttttatgggcgtttccaggagcgcgcgtgcacctccagacggggagctggcgggcgggggtggcagcagcagctctagccttggggggacaagcctctctcagctacgccaggggaaaagagagttaaggacactcacccccacccacgcacacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatagctcagctgcgacctctggcctctggggacataaacggggcggctgggccagggcggaaggtgctcctgtttccctccttctgcgtggtccctttgacgggccggccaccgtgtccgaggcgcaacgctaggcctccaggccacgcatccatctccaagttaacagcccgtcctgcccaagttctggggcaggtaggagagggccgtcacacacctgtccgcccgtgagtgacccgggggggcttccgggtggaggtggagccaccacgcccttcctcaaggggtcacttattaaaaagtccacggcctgaggccaggccctctgcacagaagccatatgccggccagccgcgcctcctcctctgtccacggaaccgctgcccatctaaccttcgtaaagacctgtctcctgtttccagccgccgcctgtggttctagcaggttctatgccatctgcattgggatgtctggttgtttttatttctgacttttttaaaattccaggtgtgccgcacccactttctcgcagtgttttaatattgtgtggagttgtcgataccacgtgaattcatacacaataaaaagcctcactctccctttt

SEQ ID NO: 139330 - DNA, 723 bp, Homo sapiens
  Payload ID: 7310
  Gene Symbol: GNG7
  Gene Name: guanine nucleotide binding protein (G protein), gamma 7
  ENST ID: ENST00000587867
  CDS Start-End: 347-457
tcaggctttcaccatctccgcctgctccagctcccctgtttcttctccctgtctgatgtcaccttgtgcttcagtgacaccttgaagtttccgggctcccacccgcctccccactgccagtctttatcagagcctgcatcttcttctttggcctgagcatcgtttttgtttgttggctttatctgtagaagaggctcctacctcaagagcagggagtggagcttggtttcgggatctcggtgctgcagacggcgagacctcctgcacagggtgtacagcaagctgtgattcctgggaaaactaaaaaagctctctgaacaacggggcccagagctgatggcagacaatgtcagccactaacaacatagcccaggcccggaagctggtggaacagctacgcatagaagccgggattgagcgcatcaaggaaagaaagcaaggagagaaaggtcgctgagtcccacagagacacagttaccggttacgggatgagatccagggccagatggacgtgtccccgtgtagcctgacccaggacaccggacaccccagccccagccctgctggggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctct

SEQ ID NO: 139331 - DNA, 216 bp, Homo sapiens
  Payload ID: 7311
  Gene Symbol: GNG8
  Gene Name: guanine nucleotide binding protein (G protein), gamma 8
  Uniprot ID: Q9UK08
  ENST ID: ENST00000300873
  CDS Start-End: 4-216
accatgtccaacaacatggccaagattgccgaggcccgcaagacggtggaacagctgaagctggaggtgaacatcgaccgcatgaaggtgtcgcaggcagcagcggaactcctggctttctgcgagacgcatgccaaagatgacccgctggtgacgccagtacccgccgcggagaaccccttccgcgacaagcgcctcttttgtgttctgctctga

SEQ ID NO: 139332 - DNA, 720 bp, Homo sapiens
  Payload ID: 7312
  Gene Symbol: GNGT1
  Gene Name: guanine nucleotide binding protein (G protein), gamma transducing activity polypeptide 1
  Uniprot ID: P63211
  ENST ID: ENST00000248572
  CDS Start-End: 149-373
aatcatattagtgaagattaggaagaagctttaaaatcccaaggctagtgtgcattgctagaattgttaagagagagagctcatatgaaattggttatcgtgggatatttaaaataaaacaaagaacagtttactttcaggcaaaaagatgccagtaatcaatattgaggacctgacagaaaaggacaaattgaagatggaagttgaccagctcaagaaagaagtgacactggaaagaatgctagtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaacccatcattctatgtttttcttaacatagctggcacagggtttaacacataattgccaataaatattgcttaaagttctttaaaaagaactatgttttataaatgattctatattattctgagttgtcagcatatatttactgttttatgttttttcacttccctttcaacacttacaattttctaccca

SEQ ID NO: 139333 - DNA, 538 bp, Homo sapiens
  Payload ID: 7312
  Gene Symbol: GNGT1
  Gene Name: guanine nucleotide binding protein (G protein), gamma transducing activity polypeptide 1
  Uniprot ID: P63211
  ENST ID: ENST00000429473
  CDS Start-End: 162-386
gctcatatgaaattggttatcgtgggatatttaaaataaaacaaagaacagtttactttgtaagttaagagctgagggaattgttggctaagactgacttgaaataactccagcaattcatgcatagctgctaaccttctacatcttcagcaggcaaaaagatgccagtaatcaatattgaggacctgacagaaaaggacaaattgaagatggaagttgaccagctcaagaaagaagtgacactggaaagaatgctagtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgt

SEQ ID NO: 139334 - DNA, 628 bp, Homo sapiens
  Payload ID: 7312
  Gene Symbol: GNGT1
  Gene Name: guanine nucleotide binding protein (G protein), gamma transducing activity polypeptide 1
  ENST ID: ENST00000430875
  CDS Start-End: 156-296
atgaaattggttatcgtgggatatttaaaataaaacaaagaacagtttactttgtaagttaagagctgagggaattgttggctaagactgacttgaaataactccagcaattcatgcatagctgctaaccttctacatcttcagcaggcaaaaagatgccagtaatcaatattgaggacctgacagaaaaggacaaattgaagatggaagttgaccagctcaagaaagaagtgacactggaaagaatgctaatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaaa

SEQ ID NO: 139335 - DNA, 1943 bp, Homo sapiens
  Payload ID: 7312
  Gene Symbol: GNGT1
  Gene Name: guanine nucleotide binding protein (G protein), gamma transducing activity polypeptide 1
  ENST ID: ENST00000455502
  CDS Start-End: 255-395
gagtgaggcaatgcctcaccctgcttcggctcgcgcacggtgcgcgcacccactgacctgcgcccactgtctggcactccctagtgagatgaacccggtacctcagatggaaatgcagaaatcaccgtcttctgcgtcgctcgcgctgggagctgtagaccggagctgttcctattcggccatcttggctcctccacaattatgatcctcttctgaaatcaggaatacgaccccaagaaatgacaggcaaaaagatgccagtaatcaatattgaggacctgacagaaaaggacaaattgaagatggaagttgaccagctcaagaaagaagtgacactggaaagaatgctaatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaaacagtaaattggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctacaaggaatgttaagtggtaccttaacaggctatagctgaagccattaaaatattaaggcctgattttttactaaatcattaaacaataatggtgcagataagtgaagagcaagctcaaaaacaacatgaataattcagtccagcaaattattcactgagcactaaagaacacagcctctgttctagatggctgggatacactgaacaaatcagccaaaggtccctgaccccttgaagctcacctagtgcaccaccatgctcaatcattgtagatgagtgtaaagaaaaattacatgtgtatacttctgagaatttagggatggtgataagccaggaatttaataattattcattctcctccacctttactagtcacatttttgggatgaggaaaaagatttaatcaatatgaactctggtgacacccttgacttctgttgccagctgtgttgtgaaccctgggtcttgtctcctttgatgttggaggcagtgtctgctgggaatctttagctggagtgtggccagctgtttttcctttgtctggagatatatccagaaggagtgggaagggtgcaactttcttctttcctacaaagtaaatatgcattggtgtaaagtagagagaatcaaactgaaattatacaacctgaaaatttattgtaataaataaattcctggcatctggagtattctgttttaaaccaaatgagtcatccctttttccttccccttaaggtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaa

SEQ ID NO: 139336 - DNA, 731 bp, Homo sapiens
  Payload ID: 7312
  Gene Symbol: GNGT1
  Gene Name: guanine nucleotide binding protein (G protein), gamma transducing activity polypeptide 1
  ENST ID: ENST00000428834
  CDS Start-End: 63-203
gaaattggttatcgtgggatatttaaaataaaacaaagaacagtttactttcaggcaaaaagatgccagtaatcaatattgaggacctgacagaaaaggacaaattgaagatggaagttgaccagctcaagaaagaagtgacactggaaagaatgctaatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaaacagtaaattggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctac

SEQ ID NO: 139337 - DNA, 889 bp, Homo sapiens
  Payload ID: 7313
  Gene Symbol: GNGT2
  Gene Name: guanine nucleotide binding protein (G protein), gamma transducing activity polypeptide 2
  Uniprot ID: O14610
  ENST ID: ENST00000300406
  CDS Start-End: 312-521
tggatgaagagtgagctaggagaacttcgtaaggtgaaactgtggggatccaatgggcaacacaaagcatcttggttaaggaggttaggggccggtctaggacttgcctcaggaggaaggacagcctcagagcatgctcagaggtgggaagggaaggaggagaaagcaggcgaagcggggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatttcctccacctgctgggtctctgctgaccttgctgggaacactctgaggacagtgtggctggccgagcggttggccccatgggtggtggggtgtgagaagcctgcaataccccaagaccccagagggcagtccttaggaagcacttacaccacctgggaacccctccgtcttttccctctactctcatcct

SEQ ID NO: 139338 - DNA, 522 bp, Homo sapiens
  Payload ID: 7313
  Gene Symbol: GNGT2
  Gene Name: guanine nucleotide binding protein (G protein), gamma transducing activity polypeptide 2
  ENST ID: ENST00000503070
  CDS Start-End: 91-357
ggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggacccacatttaacgccttacttcttttgctgggaagagcttcttggttggagctaacctggtctaggacaccgtagctgcctagaagacatcacatgaatccatagatggtggtgttggcagggaatacaaactcaattcctgaataagtgcctattccagtgaggacaattctgtgtcccttccattgacctgccaccagagaactggatggttgccttgaggtctggtactgtatgagg

SEQ ID NO: 139339 - DNA, 585 bp, Homo sapiens
  Payload ID: 7313
  Gene Symbol: GNGT2
  Gene Name: guanine nucleotide binding protein (G protein), gamma transducing activity polypeptide 2
  Uniprot ID: O14610
  ENST ID: ENST00000507680
  CDS Start-End: 264-473
attccgggacaagaggaagtcagtcctgctccccgagcctgtgtctctctgtcccctgcccagaggaagggggaagccaggggcccatttgggggcccagcccccaatcccacccagcagaggaagccaaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaag

SEQ ID NO: 139340 - DNA, 500 bp, Homo sapiens
  Payload ID: 7313
  Gene Symbol: GNGT2
  Gene Name: guanine nucleotide binding protein (G protein), gamma transducing activity polypeptide 2
  Uniprot ID: O14610
  ENST ID: ENST00000511673
  CDS Start-End: 291-500
tttttattgaatgagtggatgaagagtgagctaggagaacttcgtaaggtgaaactgtggggatccaatgggcaacacaaagcatcttggttaaggaggttaggggccggtctaggacttgcctcaggaggaaggacagcctcagagcatgctcagaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctga

SEQ ID NO: 139341 - DNA, 783 bp, Homo sapiens
  Payload ID: 7313
  Gene Symbol: GNGT2
  Gene Name: guanine nucleotide binding protein (G protein), gamma transducing activity polypeptide 2
  Uniprot ID: O14610
  ENST ID: ENST00000515635
  CDS Start-End: 396-605
ggcgaagcggggtaagtggggctgcagggtggaggtggagaaatagaagcgctgcgggctctaagctagtgaggtcaccaaaagtgtgaggctaacgcaaggcaaggtggtgaaaaggtggcttctgttttcgcgtttgtttttgtggggagaatgtctgtctctctgctctgctgtagtgagggcttgaaggctcaagcgggtgatgggcttagaactttgagcctatgatcagcttaggcatcagagattttggtttccaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatt

SEQ ID NO: 139342 - DNA, 918 bp, Homo sapiens
  Payload ID: 7313
  Gene Symbol: GNGT2
  Gene Name: guanine nucleotide binding protein (G protein), gamma transducing activity polypeptide 2
  Uniprot ID: O14610
  ENST ID: ENST00000511277
  CDS Start-End: 181-390
tttttattgaatgagtggatgaagagtgagctaggagaacttcgtaaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatttcctccacctgctgggtctctgctgaccttgctgggaacactctgaggacagtgtggctggccgagcggttggccccatgggtggtggggtgtgagaagcctgcaataccccaagaccccagagggcagtccttaggaagcacttacaccacctgggaacccctccgtcttttccctctactctcatcctaggaataaagcatttccacgccagagtagtttgggctgggggccagggttgggtggtcctgtccctccatatcatgtcctaccctatggtcctgttcctagtcatttagatcaccccagatggcctgatgacaacaagagtttgtgaagttatgatttca

SEQ ID NO: 139343 - DNA, 6539 bp, Homo sapiens
  Payload ID: 7314
  Gene Symbol: GNAQ
  Gene Name: guanine nucleotide binding protein (G protein), q polypeptide
  Uniprot ID: P50148
  ENST ID: ENST00000286548
  CDS Start-End: 224-1303
cgtcggcccagactatccgctcccaccgcgcccccggcccacctggtggccccggccctggccgccgcccccgcggcggttcccggagctcgtcccggacgcgcgcccgggcggcgggggctcggcggccaccgctgcctcgggggagcgagggcgggagggtgtgtgtgcgcgctgtgagcagggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttggtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacggtccattcttttctttgtccttaagatgacattgttagtgttcacgtcccatgttcagtgtccaaaccggcaatgtaaaaagtatcctgtgtggtttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggcttcgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcagaagtttgtgcctcatatctgaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaaacaccaaaaaa

SEQ ID NO: 139344 - DNA, 551 bp, Homo sapiens
  Payload ID: 7314
  Gene Symbol: GNAQ
  Gene Name: guanine nucleotide binding protein (G protein), q polypeptide
  ENST ID: ENST00000411677
  CDS Start-End: 42-551
ggtgtgcatccattatcagtgccctatggggtcaggagggaatgggggaacggtgggcagactcgcagctggattcccggagcactcatgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtc

SEQ ID NO: 139345 - DNA, 1159 bp, Homo sapiens
  Payload ID: 7315
  Gene Symbol: GNAT3
  Gene Name: guanine nucleotide binding protein, alpha transducing 3
  Uniprot ID: A8MTJ3
  ENST ID: ENST00000398291
  CDS Start-End: 95-1159
gagcattactcttgcctcctatgtccaaaccacagctgtgctcaacatttgaaaaatctgaacatataaactgacaagtatctaccaccacaagatgggaagtggaattagttcagagagcaaggagtcagccaaaagatcaaaagaactggagaaaaagcttcaggaggatgctgagcgagatgcaagaaccgtaaagctgctactattaggagcaggagaatctgggaaaagtactattgttaaacaaatgaagatcatccataagaatggttacagtgagcaagaatgcatggagttcaaagcagtaatttacagtaatacattgcaatccatcctagctattgtgaaagccatgactacccttggaattgattatgtaaatcccagaagtgcagaggaccaacgacaactttatgcaatggcaaataccctggaagatggtggcatgacacctcaactggctgaggtaataaaacggctgtggagagatccaggaattcaggcctgctttgaaagggcatctgaatatcagctcaatgactcagcagcttactaccttaatgatttagatagaataacagcatctgggtatgtgccaaatgaacaagatgttctccattctcgagtgaaaacgactggaatcattgaaactcaattctcctttaaagacttgcacttcaggatgtttgatgtaggtggacagagatctgagagaaagaagtggattcactgctttgaaggagttacatgcattatattttgtgctgcacttagtgcctatgacatggtcctcgtggaagacgaagaagtgaatagaatgcatgaaagccttcacctgttcaacagtatctgtaatcacaagtatttttcaacaacctccattgtcctgttcctcaacaaaaaagatatctttcaagaaaaggtaaccaaggtgcatcttagtatctgctttccagaatacactgggccaaatacatttgaagatgcaggaaactacatcaagaaccagtttctagacctgaatttaaaaaaagaagataaggaaatttattcccacatgacctgtgctactgacacccaaaatgtcaagtttgtgtttgacgcagttacagatataataatcaaagagaatctaaaagactgtgggcttttctaa

SEQ ID NO: 139346 - DNA, 7490 bp, Homo sapiens
  Payload ID: 7316
  Gene Symbol: GNL1
  Gene Name: guanine nucleotide binding protein-like 1
  Uniprot ID: P36915
  ENST ID: ENST00000376621
  CDS Start-End: 972-2795
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggaccctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatatggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 139347 - DNA, 5919 bp, Homo sapiens
  Payload ID: 7316
  Gene Symbol: GNL1
  Gene Name: guanine nucleotide binding protein-like 1
  ENST ID: ENST00000383450
  CDS Start-End: 1-1224
gttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcactcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 139348 - DNA, 7490 bp, Homo sapiens
  Payload ID: 7316
  Gene Symbol: GNL1
  Gene Name: guanine nucleotide binding protein-like 1
  Uniprot ID: P36915
  ENST ID: ENST00000383596
  CDS Start-End: 972-2795
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcactcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 139349 - DNA, 1094 bp, Homo sapiens
  Payload ID: 7316
  Gene Symbol: GNL1
  Gene Name: guanine nucleotide binding protein-like 1
  ENST ID: ENST00000458592
  CDS Start-End: 302-1094
gcacatctggaaggaggggtgtgcccgctgcacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatc

SEQ ID NO: 139350 - DNA, 7490 bp, Homo sapiens
  Payload ID: 7316
  Gene Symbol: GNL1
  Gene Name: guanine nucleotide binding protein-like 1
  Uniprot ID: P36915
  ENST ID: ENST00000441604
  CDS Start-End: 972-2795
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcggggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 139351 - DNA, 198 bp, Homo sapiens
  Payload ID: 7316
  Gene Symbol: GNL1
  Gene Name: guanine nucleotide binding protein-like 1
  ENST ID: ENST00000456550
  CDS Start-End: 1-198
gttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggat

SEQ ID NO: 139352 - DNA, 1093 bp, Homo sapiens
  Payload ID: 7316
  Gene Symbol: GNL1
  Gene Name: guanine nucleotide binding protein-like 1
  ENST ID: ENST00000430236
  CDS Start-End: 302-1093
gcacatctggaaggaggggtgtgcccgctgcacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggat

SEQ ID NO: 139353 - DNA, 1093 bp, Homo sapiens; identical to SEQ ID NO: 139352
  Payload ID: 7316
  Gene Symbol: GNL1
  Gene Name: guanine nucleotide binding protein-like 1
  ENST ID: ENST00000450423
  CDS Start-End: 302-1093

SEQ ID NO: 139354 - DNA, 1093 bp, Homo sapiens
  Payload ID: 7316
  Gene Symbol: GNL1
  Gene Name: guanine nucleotide binding protein-like 1
  ENST ID: ENST00000443235
  CDS Start-End: 302-1093
gcacatctggaaggaggggtgtgcccgctgcacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggac

SEQ ID NO: 139355 - DNA, 7490 bp, Homo sapiens
  Payload ID: 7316
  Gene Symbol: GNL1
  Gene Name: guanine nucleotide binding protein-like 1
  Uniprot ID: P36915
  ENST ID: ENST00000417834
  CDS Start-End: 972-2795
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 139356 - DNA, 1093 bp, Homo sapiens; identical to SEQ ID NO: 139354
  Payload ID: 7316
  Gene Symbol: GNL1
  Gene Name: guanine nucleotide binding protein-like 1
  ENST ID: ENST00000433809
  CDS Start-End: 302-1093

SEQ ID NO: 139357 - DNA, 1093 bp, Homo sapiens; identical to SEQ ID NO: 139354
  Payload ID: 7316
  Gene Symbol: GNL1
  Gene Name: guanine nucleotide binding protein-like 1
  ENST ID: ENST00000416639
  CDS Start-End: 302-1093

SEQ ID NO: 139358 - DNA, 7490 bp, Homo sapiens; identical to SEQ ID NO: 139348
  Payload ID: 7316
  Gene Symbol: GNL1
  Gene Name: guanine nucleotide binding protein-like 1
  Uniprot ID: P36915
  ENST ID: ENST00000428189
  CDS Start-End: 972-2795

SEQ ID NO: 139359 - DNA, 7490 bp, Homo sapiens; identical to SEQ ID NO: 139346
  Payload ID: 7316
  Gene Symbol: GNL1
  Gene Name: guanine nucleotide binding protein-like 1
  Uniprot ID: P36915
  ENST ID: ENST00000454829
  CDS Start-End: 972-2795

SEQ ID NO: 139360 - DNA, 1093 bp, Homo sapiens; identical to SEQ ID NO: 139352
  Payload ID: 7316
  Gene Symbol: GNL1
  Gene Name: guanine nucleotide binding protein-like 1
  ENST ID: ENST00000435788
  CDS Start-End: 302-1093

SEQ ID NO: 139361 - DNA, 7490 bp, Homo sapiens; identical to SEQ ID NO: 139346
  Payload ID: 7316
  Gene Symbol: GNL1
  Gene Name: guanine nucleotide binding protein-like 1
  Uniprot ID: P36915
  ENST ID: ENST00000437917
  CDS Start-End: 972-2795

SEQ ID NO: 139362 - DNA, 2334 bp, Homo sapiens
  Payload ID: 7317
  Gene Symbol: GNL2
  Gene Name: guanine nucleotide binding protein-like 2 (nucleolar)
  Uniprot ID: Q13823
  ENST ID: ENST00000373062
  CDS Start-End: 100-2295
gtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 139363 - DNA, 698 bp, Homo sapiens
  Payload ID: 7317
  Gene Symbol: GNL2
  Gene Name: guanine nucleotide binding protein-like 2 (nucleolar)
  ENST ID: ENST00000538069
  CDS Start-End: 1-698
cagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagccctggcacctgacgttccacgctctgctgggctttccaggcctgctgtgcatcctctgcccatggagcccatgcagcttctatgtcctctggttggagagggccctgccaaaattcaagcttcagatccctggtcagacgtcagctcctgagggaagccgtggaaccagactaccctatcaaattcttaaagcttcatgttctttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagtt

SEQ ID NO: 139364 - DNA, 2041 bp, Homo sapiens
  Payload ID: 7318
  Gene Symbol: GNL3
  Gene Name: guanine nucleotide binding protein-like 3 (nucleolar)
  Uniprot ID: Q9BVP2
  ENST ID: ENST00000394799
  CDS Start-End: 211-1824
gctcgtcagtggcttcagttcacacgtggcgccagcggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattg

SEQ ID NO: 139365 - DNA, 2040 bp, Homo sapiens
  Payload ID: 7318
  Gene Symbol: GNL3
  Gene Name: guanine nucleotide binding protein-like 3 (nucleolar)
  Uniprot ID: Q9BVP2
  ENST ID: ENST00000418458
  CDS Start-End: 174-1823
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattg

SEQ ID NO: 139366 - DNA, 547 bp, Homo sapiens
  Payload ID: 7318
  Gene Symbol: GNL3
  Gene Name: guanine nucleotide binding protein-like 3 (nucleolar)
  ENST ID: ENST00000479230
  CDS Start-End: 144-547
gacaccagcagctgaatgattagaacaggagaacactggttgccagcagtatggaaagaaaggttggggatctccaggaaacagaaagaaggagcaaaagaatcacatttgaaaatcctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggt

SEQ ID NO: 139367 - DNA, 567 bp, Homo sapiens
  Payload ID: 7318
  Gene Symbol: GNL3
  Gene Name: guanine nucleotide binding protein-like 3 (nucleolar)
  ENST ID: ENST00000474423
  CDS Start-End: 279-567
gctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaagg

SEQ ID NO: 139368 - DNA, 729 bp, Homo sapiens
  Payload ID: 7318
  Gene Symbol: GNL3
  Gene Name: guanine nucleotide binding protein-like 3 (nucleolar)
  ENST ID: ENST00000492349
  CDS Start-End: 62-478
agttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtatcttagcctaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaag

SEQ ID NO: 139369 - DNA, 2357 bp, Homo sapiens
  Payload ID: 7319
  Gene Symbol: GNL3L
  Gene Name: guanine nucleotide binding protein-like 3 (nucleolar)-like
  Uniprot ID: Q9NVN8
  ENST ID: ENST00000336470
  CDS Start-End: 140-1888
gatccggaagtcggagcctagctgcgcgagagtttctgctcgctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctaggtgctgtggctcacgtctgtaatcccagcactttgggaggccgaggtgggcagatcacctgaggtcaggagttcgagaccagcctggccaacatggtgaaaccccgtctctactaaaaatacaaaaaaatttagccgtgcttagtggcacctataatcccagctacttgggaggctgaggcaggagaatcgcctgaacctgggagactaaggcaggagaatcgcctgaacctgggaggcagaggttgcagtgagcccagacggcaccattgcactctagcctgggcaacaacacgaaactccgtccc

SEQ ID NO: 139370 - DNA, 2135 bp, Homo sapiens
  Payload ID: 7319
  Gene Symbol: GNL3L
  Gene Name: guanine nucleotide binding protein-like 3 (nucleolar)-like
  Uniprot ID: Q9NVN8
  ENST ID: ENST00000360845
  CDS Start-End: 226-1974
gtttctgctcgctcaaccgagttgtcgtgttgccctcgcttctcagatccccgccggaagtgtaagtaagaaacttctctcctcttttctcacaatgtgcgctcacctagacggccgggcagttaggatcgtctattggatgtgaaaccagagatgcccgccaacctggaatagagaggaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggcta

SEQ ID NO: 139371 - DNA, 1515 bp, Homo sapiens
  Payload ID: 7320
  Gene Symbol: GMPR
  Gene Name: guanosine monophosphate reductase
  Uniprot ID: P36959
  ENST ID: ENST00000259727
  CDS Start-End: 115-1152
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccatggcctgaagggccacatcatctctgatggaggctgtacgtgtccaggggatgtcgccaaagcctttggagctggagcagattttgtcatgctgggaggaatgttttcgggtcatacggagtgtgctggagaagtgtttgagaggaacggacggaagctcaagctcttctacgggatgagctctgacaccgccatgaacaagcacgcaggaggagttgctgagtacagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttctcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaa

SEQ ID NO: 139372 - DNA, 1684 bp, Homo sapiens
  Payload ID: 7321
  Gene Symbol: GMPR2
  Gene Name: guanosine monophosphate reductase 2
  ENST ID: ENST00000348719
  CDS Start-End: 174-1223
acctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgaactctgtttctcccacagcatctggctgccagctcaggcacaggctcttctgactttgagcagctggaacagatcctggaagctattccccaggagtatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgt

SEQ ID NO: 139373 - DNA, 1972 bp, Homo sapiens
  Payload ID: 7321
  Gene Symbol: GMPR2
  Gene Name: guanosine monophosphate reductase 2
  Uniprot ID: Q9P2T1
  ENST ID: ENST00000355299
  CDS Start-End: 462-1508
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaaccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 139374 - DNA, 1652 bp, Homo sapiens
  Payload ID: 7321
  Gene Symbol: GMPR2
  Gene Name: guanosine monophosphate reductase 2
  Uniprot ID: Q9P2T1
  ENST ID: ENST00000399440
  CDS Start-End: 142-1188
agttatgaaccctccccgccccccgtcgccaacattccttcgttcccctaaatcagcctcttgccccattgctctttgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 139375 - DNA, 1864 bp, Homo sapiens
  Payload ID: 7321
  Gene Symbol: GMPR2
  Gene Name: guanosine monophosphate reductase 2
  Uniprot ID: Q9P2T1
  ENST ID: ENST00000420554
  CDS Start-End: 300-1400
caacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 139376 - DNA, 1484 bp, Homo sapiens
  Payload ID: 7321
  Gene Symbol: GMPR2
  Gene Name: guanosine monophosphate reductase 2
  Uniprot ID: Q9P2T1
  ENST ID: ENST00000456667
  CDS Start-End: 66-1028
tgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattg

SEQ ID NO: 139377 - DNA, 573 bp, Homo sapiens
  Payload ID: 7321
  Gene Symbol: GMPR2
  Gene Name: guanosine monophosphate reductase 2
  ENST ID: ENST00000559479
  CDS Start-End: 1-265
gaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgta

SEQ ID NO: 139378 - DNA, 2160 bp, Homo sapiens
  Payload ID: 7321
  Gene Symbol: GMPR2
  Gene Name: guanosine monophosphate reductase 2
  ENST ID: ENST00000561038
  CDS Start-End: 335-547
gcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagtcctaggttcctgggagtttctgggatgtgccccaaatgggatgtgtttttcttatatacaagttgttcactttgaaatggaagatgctgctcctgtcagtactattacctgcctctatacttgttgctgagaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacaggtatgtgtggaggcccaggagcttagtaatagtatggaggcagaactcatggctgctgagagggggatggtacagttctcagagaagcatggtgaaccggggctcaatgctagggtctgtggaaaagtccctgggcttaaggaatccagaaggagaagataataaagtttttcctactttaagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgt

SEQ ID NO: 139379 - DNA, 657 bp, Homo sapiens
  Payload ID: 7321
  Gene Symbol: GMPR2
  Gene Name: guanosine monophosphate reductase 2
  ENST ID: ENST00000558748
  CDS Start-End: 1-419
gggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 139380 - DNA, 360 bp, Homo sapiens
  Payload ID: 7321
  Gene Symbol: GMPR2
  Gene Name: guanosine monophosphate reductase 2
  ENST ID: ENST00000559943
  CDS Start-End: 1-193
tggagtggggtatccacagctcagcgcagtgatggagtgtgcagatgctgctcatggcctcaaaggccacatcatttcagatggaggttgcagctgtcctggggatgtggccaaggcttttgagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggc

SEQ ID NO: 139381 - DNA, 817 bp, Homo sapiens
  Payload ID: 7321
  Gene Symbol: GMPR2
  Gene Name: guanosine monophosphate reductase 2
  ENST ID: ENST00000558760
  CDS Start-End: 299-565
aacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagtcctaggttcctgggagtttctgggatgtgccccaaatgggatgtgtttttcttatatacaagttgttcactttgaaatggaagatgctgctcctgtcagtactattacctgcctctatacttgttgctgagaagttctctctcttcactgctgtccataagcactatagcctcgttcagtggcaagagtttgctggccagaatcctgactgtcttgagcatctggctgccagctcaggcacaggctcttctgacttt

SEQ ID NO: 139382 - DNA, 346 bp, Homo sapiens
  Payload ID: 7321
  Gene Symbol: GMPR2
  Gene Name: guanosine monophosphate reductase 2
  ENST ID: ENST00000558279
  CDS Start-End: 174-346
tgttggcgtggcccagaaggcttagcgggattgcacgaggttagttgctaagcaaggtggtctttggtcaactgccgcctggaccaaggcaacaggaagtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagca

SEQ ID NO: 139383 - DNA, 857 bp, Homo sapiens
  Payload ID: 7321
  Gene Symbol: GMPR2
  Gene Name: guanosine monophosphate reductase 2
  ENST ID: ENST00000558483
  CDS Start-End: 1-510
tttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacat

SEQ ID NO: 139384 - DNA, 1893 bp, Homo sapiens
  Payload ID: 7321
  Gene Symbol: GMPR2
  Gene Name: guanosine monophosphate reductase 2
  Uniprot ID: Q9P2T1
  ENST ID: ENST00000559836
  CDS Start-End: 383-1429
gcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 139385 - DNA, 1719 bp, Homo sapiens
  Payload ID: 7321
  Gene Symbol: GMPR2
  Gene Name: guanosine monophosphate reductase 2
  ENST ID: ENST00000559104
  CDS Start-End: 254-1255
ttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 139386 - DNA, 1562 bp, Homo sapiens
  Payload ID: 7321
  Gene Symbol: GMPR2
  Gene Name: guanosine monophosphate reductase 2
  ENST ID: ENST00000559910
  CDS Start-End: 189-1136
tcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatattt

SEQ ID NO: 139387 - DNA, 842 bp, Homo sapiens
  Payload ID: 7321
  Gene Symbol: GMPR2
  Gene Name: guanosine monophosphate reductase 2
  ENST ID: ENST00000561130
  CDS Start-End: 116-328
cgccaacattccttcgttcccctaaatcagcctcttgccccattgctctttgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagtcctaggttcctgggagtttctgggatgtgccccaaatgggatgtgtttttcttatatacaagttgttcactttgaaatggaagatgctgctcctgtcagtactattacctgcctctatacttgttgctgagaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccac

SEQ ID NO: 139388 - DNA, 1748 bp, Homo sapiens
  Payload ID: 7321
  Gene Symbol: GMPR2
  Gene Name: guanosine monophosphate reductase 2
  ENST ID: ENST00000559287
  CDS Start-End: 249-476
ctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaaccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggatgctgtatttcaattgctctgtctcaggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaa

SEQ ID NO: 139389 - DNA, 583 bp, Homo sapiens
  Payload ID: 7321
  Gene Symbol: GMPR2
  Gene Name: guanosine monophosphate reductase 2
  ENST ID: ENST00000560139
  CDS Start-End: 189-583
tcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggcagggaatgtggtaacaggagagatggt

SEQ ID NO: 139390 - DNA, 601 bp, Homo sapiens
  Payload ID: 7321
  Gene Symbol: GMPR2
  Gene Name: guanosine monophosphate reductase 2
  ENST ID: ENST00000559409
  CDS Start-End: 149-601
cagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatg

SEQ ID NO: 139391 - DNA, 517 bp, Homo sapiens
  Payload ID: 7321
  Gene Symbol: GMPR2
  Gene Name: guanosine monophosphate reductase 2
  ENST ID: ENST00000558788
  CDS Start-End: 1-280
agcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaa

SEQ ID NO: 139392 - DNA, 231 bp, Homo sapiens
  Payload ID: 7321
  Gene Symbol: GMPR2
  Gene Name: guanosine monophosphate reductase 2
  ENST ID: ENST00000558932
  CDS Start-End: 1-209
gtatgctgggggcgtggctgagtacagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctccc

SEQ ID NO: 139393 - DNA, 721 bp, Homo sapiens
  Payload ID: 7321
  Gene Symbol: GMPR2
  Gene Name: guanosine monophosphate reductase 2
  ENST ID: ENST00000559102
  CDS Start-End: 283-564
cctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtg

SEQ ID NO: 139394 - DNA, 877 bp, Homo sapiens
  Payload ID: 7321
  Gene Symbol: GMPR2
  Gene Name: guanosine monophosphate reductase 2
  ENST ID: ENST00000561035
  CDS Start-End: 159-877
ctctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaaggttcctgggagtttctgggatgtgccccaaatgggatgtgtttttcttatatacaagttgttcactttgaaatggaagatgctgctcctgtcagtactattacctgcctctatacttgttgctgagaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatcc

SEQ ID NO: 139395 - DNA, 2025 bp, Homo sapiens
  Payload ID: 7321
  Gene Symbol: GMPR2
  Gene Name: guanosine monophosphate reductase 2
  ENST ID: ENST00000557854
  CDS Start-End: 278-1561
atcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacaggtatgtgtggaggcccaggagcttagtaatagtatggaggcagaactcatggctgctgagagggggatggtacagttctcagagaagcatggtgaaccggggctcaatgctagggtctgtggaaaagtccctgggcttaaggaatccagaaggagaagataataaagtttttcctactttaagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 139396 - DNA, 735 bp, Homo sapiens
  Payload ID: 7321
  Gene Symbol: GMPR2
  Gene Name: guanosine monophosphate reductase 2
  ENST ID: ENST00000558865
  CDS Start-End: 359-735
cgccctgccgccgccgaagctggaattcgtcggctagtagttctcgccggcaactagaggaacctgttggcgtggcccagaaggcttagcgggattgcacgagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgg

SEQ ID NO: 139397 - DNA, 1910 bp, Homo sapiens
  Payload ID: 7321
  Gene Symbol: GMPR2
  Gene Name: guanosine monophosphate reductase 2
  ENST ID: ENST00000620807
  CDS Start-End: 403-1449
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagagcatctggctgccagctcaggcacaggctcttctgactttgagcagctggaacagatcctggaagctattccccaggaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgt

SEQ ID NO: 139398 - DNA, 3035 bp, Homo sapiens
  Payload ID: 7322
  Gene Symbol: GBP1
  Gene Name: guanylate binding protein 1, interferon-inducible
  Uniprot ID: P32455
  ENST ID: ENST00000370473
  CDS Start-End: 221-1999
ggagtcagtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccgttagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaactcttaacactcatacttgaaaactttctgagtttccccagaagagaatatgggattttttttgacatttttgactcatttaataatgctcttgtgtttacctagtatatgtagactttgtcttatgtgtgaaaagtcctaggaaagtggttgatgtttcttatagcaattaaaaattatttttgaactgaaaa

SEQ ID NO: 139399 - DNA, 2220 bp, Homo sapiens
  Payload ID: 7323
  Gene Symbol: GBP2
  Gene Name: guanylate binding protein 2, interferon-inducible
  Uniprot ID: P32456
  ENST ID: ENST00000370466
  CDS Start-End: 270-2045
atattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgtttt

SEQ ID NO: 139400 - DNA, 3687 bp, Homo sapiens
  Payload ID: 7323
  Gene Symbol: GBP2
  Gene Name: guanylate binding protein 2, interferon-inducible
  Uniprot ID: P32456
  ENST ID: ENST00000464839
  CDS Start-End: 839-2614
gttgaagaagtacgagaagaccaactggatagtaatttccagatgcaatcagaaaatttctgttcttatatcttcacccatgcaaagaccaagaccctgagagagggaatccttgtcactggaaaccggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttgcacaccgatgctccagaattgtgagggagccatactctacagctattccaccgaggataatactaccattgtaaaggcatctcacgggaaaacaacacagctaccatgaaccagcaccatgatctctggatgaaatgctggaagcttctgcagtgtcagctatgagtaaatggatgccaccaccttcacattttcagtaaacaaatactcccctaccccatgaaaagttgcatctttgagctgctcacatctccagctaagcctcacaaaagtcaatctgcagggaagaatctaaatcatatgcctacccatgggaaagtctgagaattagagtatttttgtcttctacttttggaggaagaaactaataacgtgggaaattttcctgtatgtttagtcaaccagtttttccatgcagatgtatggagataaatcttatagtaggaataacctaagacttgagttagtatttttgtgtacatcagatacaacactcttctcatcttttttgtcattatttttcaatgttgttttaatctttccactgttgtttcatgtcatgcactttgttaatattctttaagttattcttagtttttaacaatgatacttaagaaagacttaataggactatagaataggtactccctattccccaaccctgggaacacaatttaacatattagttcatttgtatttaagatctatcttgtttatgcctcagtttagttattgctcttacctttcaaacagttagtattttgtatctagttctgtgaaagcaaaaagcaactttattctttcttacaattccccttttacttaatcggaacatttctttcctgtttgttcattagtcactctcagataaatgaatagtctctttttctaaaaaaaaaaataacatttgacctaaa

SEQ ID NO: 139401 - DNA, 2062 bp, Homo sapiens
  Payload ID: 7324
  Gene Symbol: GBP3
  Gene Name: guanylate binding protein 3
  ENST ID: ENST00000235878
  CDS Start-End: 178-606
attacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtagtatccttttgtgacccagaacagcaccaaggtcagaggggacacctgtattcataaaccagctgcctgactgtgaatcctgatgaatcaagctcaaaaggagaaaacaaaaaataatgcaagtacagaggagagatcccatctatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctg

SEQ ID NO: 139402 - DNA, 3067 bp, Homo sapiens
  Payload ID: 7324
  Gene Symbol: GBP3
  Gene Name: guanylate binding protein 3
  Uniprot ID: Q9H0R5
  ENST ID: ENST00000370481
  CDS Start-End: 222-2009
cttccttgaaagaagtactttcagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataagtttcactagt

SEQ ID NO: 139403 - DNA, 411 bp, Homo sapiens
  Payload ID: 7324
  Gene Symbol: GBP3
  Gene Name: guanylate binding protein 3
  ENST ID: ENST00000445969
  CDS Start-End: 1-411
caagatgaagagctggaccctgaatttgtgcaacaagtagcagacttctgttcctacatctttagcaattccaaaactaaaactctttcaggaggcatcaaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggtatccaaatgc

SEQ ID NO: 139404 - DNA, 2455 bp, Homo sapiens
  Payload ID: 7324
  Gene Symbol: GBP3
  Gene Name: guanylate binding protein 3
  ENST ID: ENST00000489444
  CDS Start-End: 118-990
caacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaa

SEQ ID NO: 139405 - DNA, 702 bp, Homo sapiens
  Payload ID: 7324
  Gene Symbol: GBP3
  Gene Name: guanylate binding protein 3
  ENST ID: ENST00000461384
  CDS Start-End: 1-656
tgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggtatccaaatgcatcaccttgtggttcgtttttctgttttctctctgttcttcctgatcacaaacttagtatggcagagcgaacataaagcccaggggaagga

SEQ ID NO: 139406 - DNA, 583 bp, Homo sapiens
  Payload ID: 7324
  Gene Symbol: GBP3
  Gene Name: guanylate binding protein 3
  ENST ID: ENST00000568006
  CDS Start-End: 143-433
actgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggtgagtggcatgagcaaagctctgccaagtcccttctgtcccccaacacagtcagcatccattatgaggatgtgaggagagaaagctggcactgggaataagctaactttccattcacagttgggctccttatcttcactcttctaggggataagcatcagctcacagctgttctgagggcttctctctgggctccacagtgaaatctcacaccaaaggaatctggatgtggtgtgtgcctcaccccaaaa

SEQ ID NO: 139407 - DNA, 599 bp, Homo sapiens
  Payload ID: 7324
  Gene Symbol: GBP3
  Gene Name: guanylate binding protein 3
  ENST ID: ENST00000564665
  CDS Start-End: 231-599
actttcagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacaggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtat

SEQ ID NO: 139408 - DNA, 2561 bp, Homo sapiens
  Payload ID: 7324
  Gene Symbol: GBP3
  Gene Name: guanylate binding protein 3
  ENST ID: ENST00000493594
  CDS Start-End: 234-509
gttactgagtcacttccttgaaagaagtactttcagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggctggagtacagtggcaagatctcagctcaccacagtcttgacttcctgggctcaagcaatcctctcacctcagcctcctgagtaggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatgg

SEQ ID NO: 139409 - DNA, 6127 bp, Homo sapiens
  Payload ID: 7325
  Gene Symbol: GBP4
  Gene Name: guanylate binding protein 4
  Uniprot ID: Q96PP9
  ENST ID: ENST00000355754
  CDS Start-End: 99-2021
ctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaatacatggcccaaatggagaagaagttggaggaggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccaggtaagaaaatataaaatgaggtttattttattttaataacataacactgttgctcattttgtaagtatatgtgttatagcagtttcattcaagaaaagtttaaaattaaaaagtgattatcaaagaatatcagggcctgacatccacaaaaaacaaacttaattttgattgaactaataatttataaacatgggaaacaagtcagaagtagtgacattattcctagaaaagatttaaggaaagcaaaaagacaactggtaagattaagaagccattaaccatttgcaatttatattatagtcacagaaataatttcagttatgactagctcttgccgattaatgagaagagagcagctccacaatttttaatttttttaacttttattttagattcaggggtatatgtgcaggtttgttacataggtaaactgcatgtcatgggggtttggtgtgcagataattttatcacacaattattaatcataatacccaataggtttttttctgatcttctccctcctcccaacctacaccctcaagtagaccccagtgtctcttgttctcctctgagtatccatgtgttctctttgtttggcccccatttataagtgagaacatgtggtatttgggtttctgttcctgtgttagtttgcttatgataatggcttccagctccatccatattgctacagaggacatgatcttgttgttttttatggctgcatagtattccatggtgtttgtatataccacattttcattatccagcctattattaatgcacatttaggttgattccttatctttgctattgtgaacagtgctgcaatggacatacacgtgcatgtgcctttatggtacaatgatttatatttccttgggatatgcattcctttgggaataatgggattgctgagttgaatggtaattctgagttctttgaggaatcaccaacctgctttccacagtggctaaactaatttacactcccaccaacagtgtatgtgttccattttctccacaaccttgccagcatctgttatttattgactttctagtaacagccattctgactggtgtgagatggtatgcatttctgtagtgattagtgatgatgagtgatttttatatgctttttaaatgcatatatgtcttcttttgaaatgtgttcatgttctttgcccactttctttttaatggggttgcttgtttttcgcttgtaaattttttgaagcttcttatagattctggatattagatctttgttggatgcatagttggcaaatattttctaccattctgtaggttgtctgttactttgttaattgtttcattttgttttgtttttgttttttgaaacagggtctcactttgacacccaggctggagtgcagtagcacaaacatgggtcattgtagcctcaacctcccaggctcaagcagtcctttcacctcaaccccccacatagctgggactacaggtgcttacacccaagaccagttaattttttgtatttgtttgtagagatgtgtttttccatgttgcccaagctggtcttgaactactgagctcaagcaatctgcctgcttcagcctcccaaagtactgggatttaggcatgagccaccacatctggccaatagtttcttttgatgtgcagaagctctttaatttaattagatctcctttgtcagtttttgtttttgctgcaattgcttatgttatcttcatcatgaaattttagccaagtcttatgtccagaatggtatttcttaggttatttttcagagtttttatagtttaatgttttatatttaagtctttaatccttcttaagttgatttttgtatgcagagtaagctgggggcccagtttcaatcttctgcatatggctagccagtaatcccagcaccatttattaaatggggacttctttccccattgcttgtttttgtcagctttgtccaagatcagatgattgtaggtgtacagcattatttctggactctctgttatgttccatttatctgtgtgtctgtttttctactaataccatgctgttttggttactgtagctctgtagtatggtttgaggtttggtaacttgatgcctccccttttgttctttatgtttaggattgccttggctaggctcttttttggttccatatgaattttaaagtagtttctaattctgtgaagaatgtcattggtagtttgatagggatagcattgaactatttgctcaactcaacattttaggaatttatttctgctgtctagtgctcaaaacttgcagctagaattgagggaagagagagaccttcttatattgttttatattgtttgatactcagtacctgttttaagaaaaaacaacaaggaagtaaaaccaaagacaggcagcccagcgccaggcccaaaaccaggcctgggcctgcctggcctaaacccagtagttaaaaatcaactcattgcctgtaatcccagcactttgggaggccgagacgggtggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccaggaggcggagcttgcagtgagtcgagatcgcgccactgcactccagcctgggcgacagagcgaaactccgtctcaaaaaaaaaaaaaaaaaatcaactcataacttagaaaccgatgttattcatagattccagacattgtatagaagaacatttggaaactcactgccttgttctgtttctctctgaccaccagtgcatgcagcccctgtcatgtaccgcctgtttgctcaaatcaatcatgaccctttcatgtgaaatctttagtgttgtgagcccttaaaagggacagaaattgtgcattcaaggagcttggattttaaggcagcagcttgctgatgccaccagctgaaaaaagcccttccttctccaactcggtgtctgagaagttttgtctgcagctcatcctgctacagaatgaactccttgtaattctacaagatatgccatgggccttttcacaggggacacaggcttcttaaaacaacccggcttcctcaccctatgtcctttatttacaaagctgtgctcctattcatgagcatggaatgtttttccatttgtttgtgacatctcttatttctttcaggggtatcttgtaattctcattatatatatcttttgcttccttggttagctgtatttttaggtattttagtcttcttgtggcaattgtgaatgggattgcattcctgatttggctcttggcttaatgttattaacgccacattttttaaatagacaaaaatatgagattaaaaatgttgaattttactaacaataaaagttgttcaaaggaaaactataaggttcttgtttcaactctgtcataggaagaacaggacagtgagctggcacagagttagggaaactgactgtgtctcatattggctagtgagagtgatctgttggaattgtatatcaaaattttaatgtacatacattttgtctagcaattctactattgggtatttatatagtacatataaatataaatgtatatgtttagtaaatatatacttatagttagtaaatatattttatatctatttagtaaatatactaaatgtcaggcctctgagcccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattgctcaca

SEQ ID NO: 139410 - DNA, 2011 bp, Homo sapiens
  Payload ID: 7326
  Gene Symbol: GBP5
  Gene Name: guanylate binding protein 5
  Uniprot ID: Q96PP8
  ENST ID: ENST00000370459
  CDS Start-End: 129-1889
gctaattgttgtagatcatcacttcaaggtgcccatatctttctagtggaaaaattattctggcctccgctgcatacaaatcaggcaaccagaattctacatatataaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaacttt

SEQ ID NO: 139411 - DNA, 4699 bp, Homo sapiens
  Payload ID: 7326
  Gene Symbol: GBP5
  Gene Name: guanylate binding protein 5
  ENST ID: ENST00000443807
  CDS Start-End: 3250-4699
cttgctgctgctcactctttgggtccacactgcctttatgagctgtaacactcactgggaatgtctgcagcttcactcctgaagccagcgagaccacgaacccaccaggaggaacaaacaactccagacgcgcagccttaagagctgtaacactcaccgcgaaggtctgcagcttcactcctgagccagccagaccacgaacccaccagaaggaagaaactccaaacacatccgaacatcagaaggagcaaactcctgacacgccacctttaagaaccgtgacactcaacgctagggtccgcggcttcattcttgaagtcagtgagaccaagaacccaccaattccggacacggtaagactggggcaagaggtggaagagatttgcaagattcatttggttttagaaacattctacaaaggataggatgcagcttatcctgatgtggtatatcagacctcagtaaagaataaattgtattcttatcagacaggcagcagaattcatcaagtaccagctgtgtctgcctcttgctgaattagacatcaatgtgtgtggtgactaaactaagagtttgaaatgccttcaaattatttttcttcctttgcaattttatgacttattcaggatcataatttccacttaagttaccttcgtccttcataaaatctgattaaactgactcgaacttcagcatgaaagtttcaaaaactatgatagctattattttcatgagaaagaacaatgaatatgatgcaatgtaagtagcttgcaaacattaaggacaagaaaaaaatgttgcccagagagaagtttcatgaaaacagtgatgtatttttagtcatagtcttgtactttgtttgaaagtagatttcttcctttagcaatagccctgacttaattcatgttggtttcttggcatctactcacttaactaaccccttttgtgttgggttctgcttctactactctattgcctttactattatgaatcacctaatttaacagttgcccaactggatccctcaatactgtctggcaactgttcactcgttgaaattctctcctttgaatttcttaccatgacacatacttcaagcattttgtactagtttgatttccatttatatccttaataagagccttttccttttccttgaaattcaaaccagaaactatgcaaaataagcaaaagcaagcaataacaactacatatacaaatgcaggcgcaaaacccaaactagaatcatatggctgaaaacagatgttttctttcagaaatccttccactaccacttctgagcattttctcttagtatttttttttgggcattttccttctttgcactttttaaaatctcctgcagctcgctcactctctttcataagccagcagttatactgatgttaataaatagttgtttatttacttttgcttttttagaaaacaagctgaaagaattgagtgaaatgccagagagatacagatagccagttgtagggctggggttggaaatcaagtctaatttaaggcaagggcaaaatgtgcattttgtgtgtgtattttgaaccattcttgcattgtttttatttgcaaaggttatagggctcaagcagttagggagaatgcatcccagaacactaagttatgaataacagagcaacagttatgtttgtggcttgaacacattaaatctgcaataatgttttagaaatttggctttactaaaagcattaaagatgctatccagatgacattggggacaacatgtcaaatactattattaatgtagatatacaatgctattgtcattcataagagagtctgaacactcagacacattcattccctcttccttagtgacatcatcccaaatcataagatcttgtaagctctcaatatctgcttatagatttggcttatgtatcttttgtttttctagctaattgttgtagatcatcacttcaaggtgcccatatctttctagtggaaaaattattctggcctccgctgcatacaaatcaggcaaccagaattctacatatataaggtactaatactacattgaaaatagattagaatgagaagagacctgccatttgagtctctaaatttgttgcaaaattgcctctttctgggtcaggcttgcactaggcatttcctgactcccatgtcctagtgctacaccatttgcaaatggatatcctattttctgctgccaagcagtttctgttttaatttatgtcaacataatgatttccagggcattagctatgaggaagcagggagaatgggtcttcataattgtaaaatgacagtttttgaaatttgctagtaaagagatggagaatccaaaccttttcattgtaagattttagtgaaagaactcgtcaagcggatagtgaagttttagcatccttagtaaataaccacctttaaaatggaagaaaactatcctttatgataaggcaaagtagaaaagcatatttttatggcatttgctttttctcatatagctcaaacattttttttaaccagagactctttaggttatagggattgatgctcagaagttagaaaaaaataggttaagtattattaaaggaagttgttttactcattcagtcaatcataaaataatcatgctttgaagttttggtttaataaagcacattagtaactatgtaaaaaatttcaagtatatcactaagaagcaaacagctatgatttgttagataatgctgcataatgacttggtagtatttaatgtaatgcagtttgactggacatagatctaactgaaaaaaatgaagttgacacaaagtaaaaggaacagtgtaatatattaataaagaacatcataaagaattaatataggaacccagggaggtaaaaactaaaaaacataactaagccaaaaaccaatggaataagagttagattcaaactagtaggttagacgcaggaaatggattttcgtatgcctatcaaatatttaagaaccagtagaatggcctatagtagacatataaagggcctaggacttacttttgttttaaaataaagtctctctattttacaggactctttttattttaaaactttttttttccagaaacttaggcagtgctggggagtagtatgtccccaggttcagtaagcaaaatgacttcctttgcttattaaacaaacaccagaaattccagcctatcccatctgttcccttgcaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacgg

SEQ ID NO: 139412 - DNA, 2454 bp, Homo sapiens
  Payload ID: 7327
  Gene Symbol: GBP7
  Gene Name: guanylate binding protein 7
  Uniprot ID: Q8N8V2
  ENST ID: ENST00000294671
  CDS Start-End: 140-2056
aagaaaaaaagtgggagaaatcagtgcagccaaattcagaactaaagagaagagaataaagactcataactttctcattgaagctgccttcttaccaagtccagaggatctctactctggacagaggaacgccctgaacatggcatcagagatccacatgccaggcccagtgtgcctcactgagaacactaaagggcatctggtggtgaattcagaagctctggaaatcctgtctgccattacacagcctgtagtagtggtggcaattgtgggcctctaccgcacaggcaaatcctacctaatgaacaagctggctgggaagaacaaaggcttccctctgggctgcacagtgaagtctgaaaccaaaggcatctggatgtggtgtgtgccccacccctccaagccaaaccacaccctgatccttctggacacggagggcctgggtgatatggaaaagagtgaccctaagagtgactcgtggatctttgccctggctgtgcttctaagcagcagctttgtctacaacagcatgggcaccatcaaccaccaggccctggagcagctgcactacgtgactgagctaacagagctaatcagggcaaaatcgtgccccagacctgatgaagttgaggactccagcgagtttgtgagtttctttccagactttatttggactgttcgagattttaccctggagctgaagttagatggacaccccatcacagaagatgagtacctggagaatgccttgaagctgatttcaggcaagaatccccaaatccaaaattctaacaagcccagggagtggatcaggcatttctttccaaaacagaagtgctttgtctttgaccggccaataaatgacaaaaaactcttactccatgttgaagaagtacgagaagaccaactggatagtaatttccagatgcaatcagaaaatttctgttcttatatcttcacccatgcaaagaccaagaccctgagagagggaatccttgtcactggaaaccggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaaggcagacgaggtcctccagagcttcctgcagtcacaggtggttatagaggaatccatcctgcagtcagacaaagccctcactgctggagagaaggccatagcagctaagcaggctaagaaggaggcagctgaaaaggaacaggagctgctaagacaaaaacagaaggaacagcagcaaatgatggaggctcaagagagaagtttccaggaaaacatagctcaactcaagaagaagatggagagggaaagggaaaactatatgagagaactgagaaagatgttgagtcacaagatgaaggtcctagaagaactgcttactgaaggatttaaagagatatttgagtcgttaaatgaagagattaatcgactgaaagaacaaattgaagcagctgaaaatgaagagccctcagtgttttcacagattcttgatgtggctggcagtatatttattgcagcactacctggggctgctaagctagttgatttaggaatgaaaattcttagctcattatgtaataggctgagaaatcctggtaagaaaattataagctgaggtttcttttgttaaaatggtataacgctgttgctcattttaaaagtatatgtgttattgcagtttcatttaagaaaagtttaaaattaaaaagcaaatttcaaagaatattatggcctgaagttcataaaaacaaacttaattttgactaaagtaataattaatagaaatggggaacaagttagaagataaaattattcctagaaaagatttaagtaaagcaaaaggacaaatggtaatataaagaaattattttcaattaatgttatagtcacagagataatttaagttataattagctcttgcaaatcagtgagaagagagtaacgccacatattttaaacaggcaaaaatatgataataaaaatgtttaattttactgacaataaaagttgtgc

SEQ ID NO: 139413 - DNA, 2987 bp, Homo sapiens
  Payload ID: 7328
  Gene Symbol: GBP6
  Gene Name: guanylate binding protein family, member 6
  Uniprot ID: Q6ZN66
  ENST ID: ENST00000370456
  CDS Start-End: 94-1995
ggaggaaagaaaacaagaggtgagtgaggcaactgaaaactgttcttggacctgcggtgctatagagcaggctcttctaggttggcagttgccatggaatctggacccaaaatgttggcccccgtttgcctggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggcttccctctgggctccacggtgcagtctgaaaccaagggcatctggatgtggtgcgtgccccacccatccaagccaaaccacaccctggtccttctggacaccgaaggtctgggcgatgtggaaaagggtgaccctaagaatgactcctggatctttgccctggctgtgctcctgtgcagcacctttgtctacaacagcatgagcaccatcaaccaccaggccctggagcagctgcattatgtgacggagctcacagaactaattaaggcaaagtcctccccaaggcctgatggagtagaagattccacagagtttgtgagtttcttcccagactttctttggacagtacgggatttcactctggagctgaagttgaacggtcaccctatcacagaagatgaatacctggagaatgccttgaagctgattcaaggcaataatcccagagttcaaacatccaattttcccagggagtgcatcaggcgtttctttccaaaacggaagtgtttcgtctttgaccggccaacaaatgacaaagaccttctagccaatattgagaaggtgtcagaaaagcaactggatcccaaattccaggaacaaacaaacattttctgttcttacatcttcactcatgcaagaaccaagaccctcagggagggaatcacagtcactgggaatcgtctgggaactctggcagtgacttatgtagaggccatcaacagtggagcagtgccttgtctggagaatgcagtgataactctggcccagcgtgagaactcagcggccgtgcagagggcagctgactactacagccagcagatggcccagcgagtgaagctccccacagacacgctccaggagctgctggacatgcatgcggcctgtgagagggaagccattgcaatcttcatggagcactccttcaaggatgaaaatcaggaattccagaagaagttcatggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagataagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagttttttttttttttcagagtcttactctgttgcccaggctggagtacagtggtgcaatctcagctcactgcaacctctgcctcctgggttcaagagattcacctgcctcagccccctagtagctgggattataggtgtacaccaccacacccagctaatttttgtatttttagtagagatggggtttcactatgttggccaggctggtctcgaactcttgacctcaaatgatccacccgcctcggcctcccaaagtgctgggtttacaggcatgagccaccatgcccagccctcatttagcaaagttttaaacataaaaagtgcttattagaggatatcagtgcctggcccacatgagagaacagatccatacacactttgaaaaactttgttcacttttaggaaatataattttgaaaaatcatttacatacaagaggtccactgaggcattgcttttaatggcaaaatattgcaatgtacttgaatgtccttcacattagattggtaagataaattttagtatgtgcatgtactggaatattatatagccagtaaacaaattgacaatgaagctctatttgtaccagtaaagaatggtcttgaagagacattgtaaaatgaaaaaaaaaaaaaccaagttgtaaagcaatgtagattatcttatcagcatggaaaaaatgcaattattatatggaagcatgcaaatatatctctggaaagattaatcaaaatctattattattggctccttctgggaagaaccaagtgaatgtaggggttgaaggaacacatactcttcactttatactcttgaattttgtaaagaaatcttattttaccgattcagaaataaataagaaaatgtaagagacaatgctaataatgataacaataaaaaaatagtgaaattggctatca

SEQ ID NO: 139414 - DNA, 3047 bp, Homo sapiens
  Payload ID: 7329
  Gene Symbol: GUCY1A2
  Gene Name: guanylate cyclase 1, soluble, alpha 2
  Uniprot ID: P33402
  ENST ID: ENST00000282249
  CDS Start-End: 391-2682
tgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagccccagaggagtgaactccttttctcctttcctgtttccatccagctggttccagatcagcatcaaagtgaaacggatttgggtactgaaaagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagcc

SEQ ID NO: 139415 - DNA, 2532 bp, Homo sapiens
  Payload ID: 7329
  Gene Symbol: GUCY1A2
  Gene Name: guanylate cyclase 1, soluble, alpha 2
  Uniprot ID: P33402
  ENST ID: ENST00000347596
  CDS Start-End: 97-2358
cttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaagagcaagcatgtcaccgaggggcatctgacgcagttatcagtggcaggattcaacagtcttgaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaat

SEQ ID NO: 139416 - DNA, 16205 bp, Homo sapiens
  Payload ID: 7329
  Gene Symbol: GUCY1A2
  Gene Name: guanylate cyclase 1, soluble, alpha 2
  Uniprot ID: P33402
  ENST ID: ENST00000526355
  CDS Start-End: 470-2668
gaggcgggagcagagagggaaagggggcgagataggcgcgcaggcggcagaagcctctgcctctgcctccccttctgcttgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagccagttttgattatatattcctacatttagtgagttggtgggtgaggaatattttctaagtttctttttctgaacagacatttcatacatgtatcatggcagtgtggtaaacttcccaactggaagaattgtaactcggcaaaatattttagggatattacctatttttatacatatctcttctagataactacatttcgcacaacattattagattttcagaatctgcttctgtattgttagtatattatatataatgctaacctattaatctaatatagtttcccttatttagagagatcagtgcttcgactgagaatacatataaccaaggatttcagataccaagaaagcattatatgtctgcttagtaaatatatcttttagatttaactaatgtagcatggaatccagaggaaatggaatttcctaacaccagatgtatctgtaaccaagattaaagaaaggtctttttgccaccttctaacaaatatcagttaaaatgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatgaatactgaagtaggtataatcttcagaactagtaatcattatagttacagataggattccatcgcatgtcctgctcaaatgaagacctgttctcattaatcaatactgcatgaaaatattactggctcacactaaaattaggagcatcaggtgtccagagttttcctgtttgggttcagatataaaatctaagtttctattgaggttaataagctggaagcatttgtttcctttaagccttggagaggtcattttcttactcattgatagcttatgtctactgaatgcaatattcttttctgttcagggattttggctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaacaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggagagaagtattgtatttatatatctcaatttatcagaagaatcacaaattctgtattagtttatatgattttacttagagaataagtatccatttacattgccataaatgtcacgatgaagaacgtgccagagatttcttatttatcactgacaggatgtcaactacatttttcatacattataacctaagtgtattttcacagctatagtccgagataatggtccaatttgttatcattttgctaatctattatagttgattattgtagttacaatgttgctatatatgtttatgaggtactatataaaatgtctgttcattcaaacttcaatcacagaagttagaagatggagaaaaaattatatttttatttgtcctacacaatgccatctacatctcttctcttaggaattgtgattgtaacaatgtggtggcatttgttatttcatatgacttttatctatacagtattctcacttacttacaaactattaccaacagcatgcattttagtatggcagatacaagaaatttgtgtgatgttcccttagaaaccaaatgatattaaattggggaaatggttttaacccactctgcaagggatactttaaaatataatttggcacctatagctcttgcattttaatattcttttaagctgctgtttggaagaaggcaccttataactagccattagcaccaaagcatcacgttggtatcaggattattttgatggagagaatgtcatcatttgcaaataaatcagttatctaacaaaatcagaatcccccaatatgtactcagaatgtactaccctgtatcttctttgtggaccttaatcattaggtaacattggccataataaaaaataataatatgcttcagaaacatagtagttggatctcttgtctatataacgtagagaaggggaagaagacatagcttccaggtaacatgggacccaattgcgtacaatctgcctttatattcatctcttgctctatattttaagtaatttcagattttccttttaatatctgattatgtggaatcaagtgagctttgatctgggactctgagacagacattgatgcctgagacttgagagtgggtctgtaggttcagcacttcaaatgttgtttcttacagtcttgcactccttcctcttgtccagtaacaacggtgtcaggacacagtagtttagtgtgaatatgtgtgtctttccaggaaaaacaaagcaaaagaggataataacaacttaaacaaaatctcattcacaaggggagcaagacttttaattttgcaaatgcctccaaagagttccagcaataaagcaaaattaaattgatagataacaaaaggcaaagccatggagaattctgaaaaccccaccaggctctgtgttttgtatagaatcatactgctgctgaatgaaattgtgtatctaaagtcgtaaggcatcaggtaggagctcaaaattatgaccataattaaatatatttgttgaaggctccttgggtccctgactttctgagagcaggtgttgtggatggttaaggcaaaaagtaaaacttttacacacaggtttctgtcttgtcattttgagaatgactcagtccattctggaccctttcttactccattctgtcactagaaaccatctcaccccctcacgcctggccacagcaaacagcattctctcttcacttctgaacccagaatggctacagaaagggttgctggtgcctcattcaggcggataggaaggaccacacacagtcaggcctgagcaacaatgtacttctgaagtgtagtaatgaactggatgtgccggggcattgattatatctgcagcttcaccctctgctctttcttcaaaacacagtctgactccaagcacttcatacagcttcactgaatgttcctttgaaattaattataaatgactctgaataggctttgggtagcaccaggcgtctttcagctgacaatatctagaaactcaagttcaagaaccaagccctatatcgtagcttagttttttctactattagattatagaccttcagctacaaaaattatgtcatttcagaggcttctataatcatagcttaataatagatataacccaaaaatcatgatgcatgagactgaattattgaagtttaacatatttctaaacgatttatgggcagctcttgatatgaatgttcctaaaccacaaccagctggtttaacatacacataaattgtgttcatgtgattgaacaaaatttattgttaaatgggtaagttgacctcagctatggactcaatttcaagatcctcgtagtggtgaatgaagagcagacactgatattacatacagattaacaatcttgtcaggctatactgagatagtgtgcaaaattccttcctcacacttgatccaaacaattgaaacctgcgtatgactgttcttccatcccttgttttcttccttcctttgttccttctttcctttaattaaaaaaggtcactgatacatttataacacaggaagtatcacagctaatcccatattctaaaatagttttataaagtgattaatatttttagtttgtgtgtatgcatctgtgtttattgaatgtagatgtttcatgattgaaagaagtaagtttctttggaaggacttgggaatgcagagaagtaaagtttgtgtctttatttctaatatgttataaccagatcacggtttcagttaagtacctcattgccatcccatccttaagaaatgacctagttcagtggttcagctgatctgcttggaagtatctggctggcttcataagaattccgtagggagttttaggaatacagaagactagtctttaccttcagagatttggattcagtaggtctcaggtagggcctaggaatctgtgtttagaaaatcactctaagtaatgctaatatacagccagacttgggaatcattgaaaagtattcaaataatcccaattactaggaataaatacaagttgactgggatagtgatgttatttcatttgtagttattttgaaaagttaaatactctaggcctcataccattatttctttcacaaattttaattttagctttgatttccaatttgtggtcttctttctgagcatgaatcttcaaacttagagacagacgtcaacactgataagcatgagggatgaatattgctcactatagggctattaggcatactagatacagtaccattttcttagttactgccagagctgtgcagtatattacaacatttgctaatcctcaccaccgaggtaaaaactatgacctttgggacacagaagcaaatatcaaagtgacagccttacttctgaatgctttgatttttatgtcatgaaaagacatcaacttaatacttagtctcactatgtacttttcatattgaattgtacattatctgaaaactgatttccaagcaataccgtgtaacaacctttcaagcaataatttaagccatggtgatgatgccatatgaagcttgcacttctttgcatttcatagagcctttgtgaaaacagaaacatgttttatacaagcaataatatagctggtgtggactttttaaagatactcattattctgtagcaaaatgagcagcaagtaatgactcagattaaaaatattcgggcaaatgacatgtttaatctatctcagaagttattcatttgcaaacatgctgtaaagtgattaatatacatcagattatttctggtgcataattttaaacatggctataaaaatatgatttctattcctgtcaaagagatttgtgtattatttataatgttgcccaatttttggatctttgtagtatataatagtaaggaagaagttaaggatggataaatgagtggaagtagagcataggttggaagaggtgattgagaaagtaggctttgcaaaaatatagatgggtcttgcggcagatttattcaaatgttggtttgatatggtcttggaagatgaaagagtaaagataaaagagctcattattactgttttcaatgatagctacacaagtttttggtaagtatgatagtattttgacttcagaatatgattgactgaaagtcacctgtagcacaataaataaaagtctgaaaatgattattcagtaatactgaaaaaacactaaagctttcagatttcgaaatgaaaaaatcatgtttttagtctacttaaaatacaattttaatagaatgtggcatagtcaatgataatcagttctttagtagttaaatttacttcatcatttagaataatgtataaggattacagctaaaatcaactagtaaatttatgtttatactgaacagtatctaaacatcagattatgatttagcatataagcttaggattcattcctaagcatctaaataagatgacagctcctattattgccctgcaaggtaaacaatcccctaaacatgaatatgaacccatttgaatggtgggtgtgttcgatattttgtctttacctttctattactcatagcaaaacttaattttagcattctcctgcccacagtttggaaaatttccctatcaaaatcaaaccggattgttgatttactgaggctttgacaattatcctcttgtatatcactggatccttaaatccttagtaagaatggttttgggttaaataaataatggaaaatatttaatttgaatctattaaattacactgaagttatccttccagttaattcagctagttgctgatcagatcattctttatattagacttaagtattgttgcttattatttaaaagcagaaaagaaaaaccaaatggcaggtctgagtaatagttactttttgattcttttgatacatatttttaaactgaagaaatcactttatattcagtcttcttctgtggactttttgctatttgcagataaagaaggaattctacttaatatatttttactgtggtctattaaatgtcattaaacctatatctaagaggaaagtaataactgaaataaaatcaggaatgtgcaaaattgtttcttcatacctcactttctgaagacacttctttgcattctgctgcctggcatttacacagcagactcaggacaaagggacaaatggagtgagtgaggtgggcaggagctttagaagagatgaagcaaagagagttagttttttattcaggaagatgtagagactcttaaaggagaggcaatttccgtaacaaacacctctggtttaatggaagccacatgatttatttgactactggtcactcatttttaaaaagaaaagagaaagacaaaaaaagagaaacccttcacaagccatttttagttttcctaggaggtagtgccaacctctcggcagctgcacatctcagtgaagctgggatagaagcttacagagctacaaatagatgctttctgaaggtggcagatagaactagtcttggttacaatgattaaggtaaatgaaagtgtcagaacatctgggttgaaggaacaaagaaggcccaataccagctctgccatatgccacagaaaaccctgctaaaattagcatagaaaaacagactaacactatgcaagtgatattaaaacaaactatattttttccttttataacatgcctggctgagctagcattcagtgagaagaatatacttttgtcttatgaatcatttaaaaacatttgttgttgttctgacattaaataaattacatattcccttagttgaaaaatttaatcacaaataataggaaatatttattttgtgtcctgaaatttttaaacttttggcggctgtactctacgccatattcttcttcacattcttctcaaattgggtttggctgctagcaaaacaagtgtggaactttagagcagaaaaatgtccatctgtctcttacagaatgtgccagagtatttgagctggagagagaatcaccccatagcatttaatggtattctgtgagacacgaagactctagtcttctaaacttaaaagtggttaggtagtaccttaatcatcaaagatttttcacttacatgtaactggttaattcatatagagtttgtttagaacagaaactttaaaaggagggaacaaacctgagcaatttttaatcaaaattatcagttagaaaaagaatttaagacaaagatttattgtcctgaaagagtcaactcactcatatccaaaacttagaatgtcagagacttttgaaagttttctgaatgtgtcaacttcttcagcaatgagagattcaattaatgttgtttctaggttccttagagttttatcctctgatgataacacttaattgtgaattacatttaagtgatttttactttatattttccatttgttacagaaaaaaagtcataaatatgacagacttaaaaattgtggcattgagccagggtttgcaaatttggcaatattattttacttaaaatattacactttttaaaataacataaacattaaggataatagtcaaataatactgtattttcagcttgttcacattagaatatagaacaacgcattgtaaacttctcggaataaaatctaagtcaaaaccaatttatgttcaaatcatttgaacaacaaatatgaatattgttacatcacctctgactctctgactagtaagaaactatgcatttccatacccaatgaaacctcaattcctacagcaattctacttttattgcctcccaagaactatttcttcatggtcaatatcactctttaaaagctagcaaaatatgactttcttctgaggtttgggcaatctggatcaatatttatgtatctaaccacttgaaaggctgtctccttttttggccttttaaattaaaacttccataaaatgaagcaaaatatgaaaacagctagttgatttatcaataatgtgaaaccctccttctgaatttttttggtaaaaattaccacactgaaaccaaaacttaaccttggcttggactctcagataaattgcttttgtattctttgactacaaagtattctcaaaaagaagaaattatttctgatggtagatcaaactctagccaagaaggtctagataaactagaggactgtataattatctaaagtaattcagggggacttttagaaaaattctttaatttttgttcctgtgtaaaaattattattaatggatggcagcccaaattactattcttcttttaaaatttgtttcaagtgtgtcaccaggcactcataaaattcatttatttgttatataactcaatgacctgaaataataggtgctcattgctttttcatttgatccttaaaaacaattttattctgtctaaaaaaaattctcctgctaaaatccaaatgattacctggctataggaggagtcccattttatgaacatgtatgaaatatttagttggattcagatgaaatgcaacttagagaaaggaatggataccagtagagaagatggaaagagacacaaaaatcagactttgcttacatcaaaattaggtctgttgtctaatcctgttaacctagaggcaagctgaaaatagatggtaaggataaatagatttttaaacacagtatttatatttaacagaatgtcataaaaatgacagaatgccatgaaattcagcatgtcaaaactttgataaaacaaacaagaaatttaataaatatgctaattagagtgaatatttaaagggacaaaaataacttgtcacatcatagatgtctccccagtgcagaatttattatctgctgggaaaatttggttttatgtcttcaatcaatatttgctgcattatctaattaaacattagtatattttttgtgctaatgagaaaccatgcaagagtccaaatatcaagtgtggtgacagcttgaatcagttgagtttggtgttcatgaataaaattcttgatgaatgtgaaatgaatggtttatatacataagttttatgtgcagtaaattaattaggctttaaaacttgttagcatgcttagctcctcttttttccattgaattatcttcctatcttccttccttccttcctttccttcctttccttccctccctctttgctttatttctttctagctcttataagataaatgacaatagtactttactatttgggctggagcctccctttttcactttcacatgattgaacactttgtggatttgtgagaaaaggggaaagaagatgagcacgtagatgcagatcagttgaggatagaagtgactgagagaattgggaccttgacttccagagactgtcagtcaagagaaatgtgggtctataaaaatctatgtgtgttcattttcattgaatttaaacactttttcaagaagtatcagggtcaatctgtttggacaatctcctatttttacccccttacaaatgtcttaagttagaaaaacctcttattttcaagtagtcatttttttttatgtgagtaccacactgctaaagactgaaatagaaaaaaaaaatgctttttctgtttgtagggaaattgctttctgaaaactactcccaataagatgtatacatcaaatgcaacttgattttactggctctttatctagagataactgatgcactgtcttctttcttagatacccttctgtaattcagcttggcatagtatgatgttttgagttcttattgagggtttggaaacatttgtcatcaattttatgtctactctattgaaaaagcaatatacaatgtattccatatttcttagctctgtgtctttgaggttttaaacctatattcagatagctgtttttagctacaattttgagtattcaccagaatttacaaattgccattttattaaatacaaaaaaaaaaaaagtacagcttggatcaagagatcaaacatttacaaatctcaatccaaagccattatttttcagggaaaattaaatcatttctagcagagtatttgactcctaagggaaaataagtcaaatatcttctttaagagtaagggcattcttccattgtaggtatttctaattgactttataataatttgaacaaatcttgaacaagatttaaagaatttataatctcccaaacttaaaattgtattctttctggttttttatttttatgtattaagattatattcaaaccacttaattatcttcatgacataagtttgtgttaatagaaaattatacagaaaaaaacatgatttgttcctctgtggaaagatatgcttcaatgagttaaatacccttgaattttggttctcatttcttatttggacttttctgttatgtacctcaggggtcttaaattctaacagatgaagtagtcaaaggggtataaaatacttgaaaaaaattaaaacttcaaaagggacgaatttctctgttaacttttgtttatcctatactgacttattttgaaattgtgaaaaaacaggcagctaccatataaattggtatctatgaaaatactgattactttcttcctgtgattttcactgttaagaaaacctttgtcttgaaatgatggacaatcttaatacttgttcagataaagaaatgtgactttcaatacctttaccatttgtatttctttagggaaatattttaataatgattgtaaaaatagaagaaatatggttgagaaaaatagaagaaattaagatgaaatttgaacagttgtaatccacagtcccatttttccctctattttattgccttctactaagttattgaaggcccagatctgcaaaatttacaagctactaattcattgtctcctttaagaatttggagcaaaaattattccgactatgcggaaatgaattcacatcatcatggcaggttttgactatgagggaattcaggttaggttcaaatagaataatggtccatggagaaaaatactttctgatttttcttcaagttggatggaaaggtttttctttatttaaaaaaaaaaaaaaaaagtcctcctgagaattttgccttcgaaaaagaagttttataacagctgcctgtagctacattataacttcggtaattaagtgacaaaactgtctcattatgcttttaaaatactgattaagtgcattccagaaataatacatatcattcatttcaaaatcaacctacctgaattctgactcttcaatcatgagtagccattttacaaaaccaaagggtctcatttcccaaacagtactttaaatatcatcctaatagtaatatcctaatagtaataatcctattaatactcacttcaatgcataaaataaacagccaatgcacttccatcaagtctgcaggcactatataataataaataggtttccaaaatcacttaataaaaacacacagttataatgtgctcggccttcattagcatcctctgcatggggtggttttcatttaacctgaattattttaacattttggctaatttgtttgctgcaatttcatgggtctaaatttttggtttggtttgcaatgtaaatcatattgtatatctgctcctttgttattagatttactttgtgaataatatcttttaaaaattgagttatcaaaaacttaaattataatgtcatcaactaataccaggtaaatatactaatatatatgtagggcatgattaaattgcatatattttgaaatgtcaaactattttttgtttttttaaaaaaatgaatgcatctcttaaacctgtaccattaattttaaaaaagtttcatttggtatttcatattatattttaaaatatttttctttatctagtagtacaggtttaaagaaactttttctgattgaaatgataaaatatgcctcatttcactagaattttaagaataatacatgtaaaagtataactcatataagattataaatatccacaatatcttctttgattttcatgtaacaccactttttactcattcttttatttgttattattcgaaatcattcacaatgtaaatagcatgtttcatgatgtaaaatgtctttgcatttacagactgcagaacaaggtgaatttgtatatgaaaaataagtgatggaaacgtgggattcttataaaacaaagtggaaatgatagttctgtgttatatttacataattcattacaaaattgtctagttaagtcatgcatttatttaccttaaaagtgtccaaactgtcacttataaaatatttaaatcaataaataataccaaaaaggagtctgaa

SEQ ID NO: 139417 - DNA, 4400 bp, Homo sapiens
  Payload ID: 7330
  Gene Symbol: GUCY1A3
  Gene Name: guanylate cyclase 1, soluble, alpha 3
  Uniprot ID: Q02108
  ENST ID: ENST00000296518
  CDS Start-End: 210-2282
aggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacata

SEQ ID NO: 139418 - DNA, 4286 bp, Homo sapiens
  Payload ID: 7330
  Gene Symbol: GUCY1A3
  Gene Name: guanylate cyclase 1, soluble, alpha 3
  ENST ID: ENST00000393832
  CDS Start-End: 874-2172
ggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaagtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaa

SEQ ID NO: 139419 - DNA, 4352 bp, Homo sapiens
  Payload ID: 7330
  Gene Symbol: GUCY1A3
  Gene Name: guanylate cyclase 1, soluble, alpha 3
  ENST ID: ENST00000443668
  CDS Start-End: 304-720
agacacagagagacaaaggcaaggaggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaaca

SEQ ID NO: 139420 - DNA, 2631 bp, Homo sapiens
  Payload ID: 7330
  Gene Symbol: GUCY1A3
  Gene Name: guanylate cyclase 1, soluble, alpha 3
  Uniprot ID: Q02108
  ENST ID: ENST00000455639
  CDS Start-End: 374-2446
atggtgcgttttggctgctactttctttttcagtctttcggtgcggagaaggggaggaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacagtgcggatttgcgaggcgcgccctggagctgctagagatccggaagcacagccccgaggtgtgcgaagccaccaatctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttc

SEQ ID NO: 139421 - DNA, 2992 bp, Homo sapiens
  Payload ID: 7330
  Gene Symbol: GUCY1A3
  Gene Name: guanylate cyclase 1, soluble, alpha 3
  Uniprot ID: Q02108
  ENST ID: ENST00000511108
  CDS Start-End: 521-2593
ttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaa

SEQ ID NO: 139422 - DNA, 1282 bp, Homo sapiens
  Payload ID: 7330
  Gene Symbol: GUCY1A3
  Gene Name: guanylate cyclase 1, soluble, alpha 3
  ENST ID: ENST00000515201
  CDS Start-End: 195-626
attcgcagtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaa

SEQ ID NO: 139423 - DNA, 2715 bp, Homo sapiens
  Payload ID: 7330
  Gene Symbol: GUCY1A3
  Gene Name: guanylate cyclase 1, soluble, alpha 3
  Uniprot ID: Q02108
  ENST ID: ENST00000506455
  CDS Start-End: 442-2514
acacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaa

SEQ ID NO: 139424 - DNA, 1273 bp, Homo sapiens
  Payload ID: 7330
  Gene Symbol: GUCY1A3
  Gene Name: guanylate cyclase 1, soluble, alpha 3
  ENST ID: ENST00000509901
  CDS Start-End: 366-614
atcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagct

SEQ ID NO: 139425 - DNA, 2656 bp, Homo sapiens
  Payload ID: 7330
  Gene Symbol: GUCY1A3
  Gene Name: guanylate cyclase 1, soluble, alpha 3
  Uniprot ID: Q02108
  ENST ID: ENST00000513574
  CDS Start-End: 383-2455
gacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtggacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaa

SEQ ID NO: 139426 - DNA, 2552 bp, Homo sapiens
  Payload ID: 7330
  Gene Symbol: GUCY1A3
  Gene Name: guanylate cyclase 1, soluble, alpha 3
  Uniprot ID: Q02108
  ENST ID: ENST00000511507
  CDS Start-End: 305-2179
acacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttaca

SEQ ID NO: 139427 - DNA, 1788 bp, Homo sapiens
  Payload ID: 7330
  Gene Symbol: GUCY1A3
  Gene Name: guanylate cyclase 1, soluble, alpha 3
  ENST ID: ENST00000621234
  CDS Start-End: 521-952
ttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtc

SEQ ID NO: 139428 - DNA, 3124 bp, Homo sapiens
  Payload ID: 7331
  Gene Symbol: GUCY1B3
  Gene Name: guanylate cyclase 1, soluble, beta 3
  Uniprot ID: Q02153
  ENST ID: ENST00000264424
  CDS Start-End: 83-1942
gtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtg

SEQ ID NO: 139429 - DNA, 1951 bp, Homo sapiens
  Payload ID: 7331
  Gene Symbol: GUCY1B3
  Gene Name: guanylate cyclase 1, soluble, beta 3
  Uniprot ID: Q02153
  ENST ID: ENST00000503520
  CDS Start-End: 52-1812
cggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacactggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctaga

SEQ ID NO: 139430 - DNA, 2709 bp, Homo sapiens
  Payload ID: 7331
  Gene Symbol: GUCY1B3
  Gene Name: guanylate cyclase 1, soluble, beta 3
  ENST ID: ENST00000507146
  CDS Start-End: 501-2285
gatgctgcctccccggcccggttgcgctgtagccgctgccgcctctgcctgggtcccttcggccgtacctctgcgtgggggctgcctccccggctcccggtgcagacaccatggcgggtttgccgctccacaccgcagcttcctgagctcgggaaggggaggtgcggcggaggcgtggggtcttcccggctctggccggccccaccagtgtgggaggctgagcgccagcggaagggaaggctccgggttcgcgtccccgcgctgcccccgatgcccagcctctcccggagcggtgacagtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacaggatgtcctgctagaatccaggcctttaaagtacaaacgacactgatgctgtgtgaaaaggacagcagaagcactaaaggctttcccagtatttcttacagtggctttctgctgatcccactgaacagattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatatttt

SEQ ID NO: 139431 - DNA, 2355 bp, Homo sapiens
  Payload ID: 7331
  Gene Symbol: GUCY1B3
  Gene Name: guanylate cyclase 1, soluble, beta 3
  ENST ID: ENST00000513437
  CDS Start-End: 285-1940
gctgagcgccagcggaagggaaggctccgggttcgcgtccccgcgctgcccccgatgcccagcctctcccggagcggtgacagtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatat

SEQ ID NO: 139432 - DNA, 2456 bp, Homo sapiens
  Payload ID: 7331
  Gene Symbol: GUCY1B3
  Gene Name: guanylate cyclase 1, soluble, beta 3
  Uniprot ID: Q02153
  ENST ID: ENST00000505764
  CDS Start-End: 328-2127
agctcgatgctgcctccccggcccggttgcgctgtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaagagagaagaggtcttggtatgtcgcccaggctgttctcaaattcctgagctcaacggatcctcccacctgggcttcccaaagtgctgggataacaggcatgagccaacctgcccagccagaaaagagagattttaatgcttatgtgctttataaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaattta

SEQ ID NO: 139433 - DNA, 2255 bp, Homo sapiens
  Payload ID: 7331
  Gene Symbol: GUCY1B3
  Gene Name: guanylate cyclase 1, soluble, beta 3
  ENST ID: ENST00000502959
  CDS Start-End: 121-2046
gctccagctcgatgctgcctccccggcccggttgcgctgtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaagaatgaatcaaagcatatttcagatttacatcattgtttcctgggaatctacttgtgctgcaataaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattat

SEQ ID NO: 139434 - DNA, 2316 bp, Homo sapiens
  Payload ID: 7331
  Gene Symbol: GUCY1B3
  Gene Name: guanylate cyclase 1, soluble, beta 3
  ENST ID: ENST00000505154
  CDS Start-End: 280-1935
aatcagggcgggccaaggcggctgttctcgctccagctcgatgctgcctccccggcccggttgcgctgtagccgctgccgcctctgcctgggtcccttcggccgtacctctgcgtgggggctgcctccccggctcccggtgcagacaccatgaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgttta

SEQ ID NO: 139435 - DNA, 3844 bp, Homo sapiens
  Payload ID: 7332
  Gene Symbol: GUCY2C
  Gene Name: guanylate cyclase 2C
  Uniprot ID: P25092
  ENST ID: ENST00000261170
  CDS Start-End: 138-3359
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcatcctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaa

SEQ ID NO: 139436 - DNA, 3698 bp, Homo sapiens
  Payload ID: 7333
  Gene Symbol: GUCY2D
  Gene Name: guanylate cyclase 2D, membrane (retina-specific)
  Uniprot ID: Q02846
  ENST ID: ENST00000254854
  CDS Start-End: 151-3462
gattaagggctctggccggctgtacccacgcccccgccctggcctgggctggcaaggaagacctgtgggcgggcgtcaaaagggggaccggccctgtgacccctcaccgggggccgtgggcccgagcccccggacttccctaagccggcaatgaccgcctgcgcccgccgagcgggtgggcttccggaccccgggctctgcggtcccgcgtggtgggctccgtccctgccccgcctcccccgggccctgccccggctcccgctcctgctgctcctgcttctgctgcagccccccgccctctccgccgtgttcacggtgggggtcctgggcccctgggcttgcgaccccatcttctctcgggctcgcccggacctggccgcccgcctggccgccgcccgcctgaaccgcgaccccggcctggcaggcggtccccgcttcgaggtagcgctgctgcccgagccttgccggacgccgggctcgctgggggccgtgtcctccgcgctggcccgcgtgtcgggcctcgtgggtccggtgaaccctgcggcctgccggccagccgagctgctcgccgaagaagccgggatcgcgctggtgccctggggctgcccctggacgcaggcggagggcaccacggcccctgccgtgacccccgccgcggatgccctctacgccctgcttcgcgcattcggctgggcgcgcgtggccctggtcaccgccccccaggacctgtgggtggaggcgggacgctcactgtccacggcactcagggcccggggcctgcctgtcgcctccgtgacttccatggagcccttggacctgtctggagcccgggaggccctgaggaaggttcgggacgggcccagggtcacagcagtgatcatggtgatgcactcggtgctgctgggtggcgaggagcagcgctacctcctggaggccgcagaggagctgggcctgaccgatggctccctggtcttcctgcccttcgacacgatccactacgccttgtccccaggcccggaggccttggccgcactcgccaacagctcccagcttcgcagggcccacgatgccgtgctcaccctcacgcgccactgtccctctgaaggcagcgtgctggacagcctgcgcagggctcaagagcgccgcgagctgccctctgacctcaatctgcagcaggtctccccactctttggcaccatctatgacgcggtcttcttgctggcaaggggcgtggcagaagcgcgggctgccgcaggtggcagatgggtgtccggagcagctgtggcccgccacatccgggatgcgcaggtccctggcttctgcggggacctaggaggagacgaggagcccccattcgtgctgctagacacggacgcggcgggagaccggctttttgccacatacatgctggatcctgcccggggctccttcctctccgccggtacccggatgcacttcccgcgtgggggatcagcacccggacctgacccctcgtgctggttcgatccaaacaacatctgcggtggaggactggagccgggcctcgtctttcttggcttcctcctggtggttgggatggggctggctggggccttcctggcccattatgtgaggcaccggctacttcacatgcaaatggtctccggccccaacaagatcatcctgaccgtggacgacatcacctttctccacccacatgggggcacctctcgaaaggtggcccaggggagtcgatcaagtctgggtgcccgcagcatgtcagacattcgcagcggccccagccaacacttggacagccccaacattggtgtctatgagggagacagggtttggctgaagaaattcccaggggatcagcacatagctatccgcccagcaaccaagacggccttctccaagctccaggagctccggcatgagaacgtggccctctacctggggcttttcctggctcggggagcagaaggccctgcggccctctgggagggcaacctggctgtggtctcagagcactgcacgcggggctctcttcaggacctcctcgctcagagagaaataaagctggactggatgttcaagtcctccctcctgctggaccttatcaagggaataaggtatctgcaccatcgaggcgtggctcatgggcggctgaagtcacggaactgcatagtggatggcagattcgtactcaagatcactgaccacggccacgggagactgctggaagcacagaaggtgctaccggagcctcccagagcggaggaccagctgtggacagccccggagctgcttagggacccagccctggagcgccggggaacgctggccggcgacgtctttagcttggccatcatcatgcaagaagtagtgtgccgcagtgccccttatgccatgctggagctcactcccgaggaagtggtgcagagggtgcggagcccccctccactgtgtcggcccttggtgtccatggaccaggcacctgtcgagtgtatcctcctgatgaagcagtgctgggcagagcagccggaacttcggccctccatggaccacaccttcgacctgttcaagaacatcaacaagggccggaagacgaacatcattgactcgatgcttcggatgctggagcagtactctagtaacctggaggatctgatccgggagcgcacggaggagctggagctggaaaagcagaagacagaccggctgcttacacagatgctgcctccgtctgtggctgaggccttgaagacggggacaccagtggagcccgagtactttgagcaagtgacactgtactttagtgacattgtgggcttcaccaccatctctgccatgagtgagcccattgaggttgtggacctgctcaacgatctctacacactctttgatgccatcattggttcccacgatgtctacaaggtggagacaataggggacgcctatatggtggcctcggggctgccccagcggaatgggcagcgacacgcggcagagatcgccaacatgtcactggacatcctcagtgccgtgggcactttccgcatgcgccatatgcctgaggttcccgtgcgcatccgcataggcctgcactcgggtccatgcgtggcaggcgtggtgggcctcaccatgccgcggtactgcctgtttggggacacggtcaacaccgcctcgcgcatggagtccaccgggctgccttaccgcatccacgtgaacttgagcactgtggggattctccgtgctctggactcgggctaccaggtggagctgcgaggccgcacggagctgaagggcaagggcgccgaggacactttctggctagtgggcagacgcggcttcaacaagcccatccccaaaccgcctgacctgcaaccggggtccagcaaccacggcatcagcctgcaggagatcccacccgagcggcgacggaagctggagaaggcgcggccgggccagttctcttgagaagtgaggcccggccccggacagggtctgggccctgctccctgtcccatctgcagtggaccccaggcacccccctttgaggaggtggggtgaactgctccttggcagggatttgtgacactgcattgctgggctgtgttcctcgggctcttctggaccttgcaccgtggataccaggccatgtgccatggtatttgggtcctgggagggtgggtgaaataaaggcatgctgtctt

SEQ ID NO: 139437 - DNA, 3714 bp, Homo sapiens
  Payload ID: 7334
  Gene Symbol: GUCY2F
  Gene Name: guanylate cyclase 2F, retinal
  Uniprot ID: P51841
  ENST ID: ENST00000218006
  CDS Start-End: 293-3619
tctgcggatgctgaagagtgattttcaaaacatttactaacgctttcaattatttaccccattaatggaatttgtcaacagactggagtccttgacaggattgtgaatgcatagaggatgcaaagaaatggacacactgaggtagctatgccagtggtctgcatgcgcaggcagtaaactgaagacatttgagcggtgaattacttggcatttggaaacaccaccgtctgtgtcgggaaagcagaataactctccagtatctcgtcattagcttgctggaagcaggagggctatgttcctgggactcgggcgcttttctcgccttgttctctggtttgcggctttcaggaaactgctgggacaccatggccttgcatctgccaagttcctgtggtgcttgtgccttctgtctgtcatgtcccttccgcagcaggtgtggacactcccctacaagataggggtggtgggcccttgggcttgtgattcgctgttttcaaaggccctgcctgaggttgctgcgcgattagccattgagcgaatcaaccgggacccatcttttgacctgagttattcttttgaatacgtgattctcaatgaagactgccagacttcgagggctctctccagtttcatttcccaccaccagatggcctcaggatttattggacctaccaaccctggctactgcgaggcagcctcgctcctgggaaacagctgggacaaaggaattttctcttgggcttgtgtgaattatgaattagacaataaaattagctacccgaccttttctcggacactcccttctcccatccgggtgcttgtaactgtcatgaaatatttccagtgggctcatgctggagtcatttcctcagatgaagacatttgggtgcatacagccaatcgagtcgcaagtgctcttcggagccacggcttacctgtaggggtcgtcctgaccacaggacaagacagccaaagcatgcggaaagccctccagaggattcaccaggcagacagaattcgcataatcatcatgtgtatgcattcagctttgattgggggagagactcagatgcatctcttggaatgtgctcatgatctgaaaatgactgatggaacctacgtctttgttccttatgatgccctgctctacagtttaccttataagcacaccccctaccgggtcctaaggaacaacccaaagctccgggaagcctatgatgcagtgttgaccattacagtggagtcccaagaaaagaccttctatcaagccttcacagaggcagcagcaagaggtgaaattcctgagaagctggagttcgatcaagtttcaccgttgtttggaaccatctacaattcaatttactttatcgcacaagccatgaataatgctatgaaagaaaatggacaggctggtgctgccagcctggttcagcattccagaaacatgcagttccatggattcaaccagttgatgaggacagattcaaatggaaatggaatttcagaatatgtaatcctggacaccaacttgaaagaatgggaactccatagcacctacactgtggacatggaaatggagctgctacgtttcggagggacccctattcacttccctggtggcaggccccctagagcagatgcaaaatgctggtttgcagaagggaagatctgccatggaggcatcgaccctgcctttgccatgatggtctgccttactttgcttatagccctgctgtctattaatggatttgcttactttataaggcgtcgtataaataaaatccagttgatcaaaggacccaatagaattctactgactttggaggatgtaacgtttatcaatccccactttggcagtaagagaggaagtcgtgccagtgtaagcttccagattacctcagaggtccaaagtgggaggtccccaagactctccttttcttcagggagtctaactccagctacctatgaaaactccaacatagcgatttatgagggtgattgggtgtggctgaaaaagttctcccttggagattttggagaccttaagtccatcaaatcaagagcaagtgatgtgttcgaaatgatgaaggacttgcgtcatgagaatattaaccctttattgggtttcttctatgattcggggatgtttgccattgtgacagaattctgttcccgagggagcctagaagacatactgacaaatcaagatgtgaaacttgactggatgtttaaatcatcactcttgctggatctcataaagggcatgaagtacttacaccacagagagtttgttcatgggaggctaaagtctcgaaactgtgtggtagatgggcgttttgtactaaaagtgacagattatggctttaacgacatcttagaaatgctgagactctctgaagaggaatcttctatggaagagctgctgtggacggcccctgaactgttgagagctccaagaggcagcaggttaggttcttttgcaggagatgtctatagctttgccatcatcatgcaagaagtgatggtccggggtaccccattctgcatgatggatctgccagctcaagaaatcataaacagacttaagaagcctcctcctgtgtacagaccagtagttcctcctgagcatgcccctccagaatgtctccagctgatgaagcagtgctgggctgaggctgcagaacaacgaccaacttttgatgaaatatttaaccagtttaaaacttttaataaagggaagaagaccaatattattgattctatgcttcggatgttggagcaatattctagcaacttggaagatttgattcgggagcggactgaagagctggaaattgaaaaacagaaaacggaaaagcttctaacacagatgctaccaccatcagttgctgaatctctcaaaaagggctgcacagttgaacctgagggctttgacttggtcaccttgtacttcagcgacattgtgggcttcacaaccatttcagccatgagtgagcccattgaggtcgtggatcttctgaatgacctgtacacactctttgatgcaataattggcagtcatgatgtctacaaggtagagaccattggagatgcctacatggtggcttcaggcctcccaaagaggaatggcagtaggcatgcagctgagattgcaaacatgtccttagatatcctgagctctgtgggcactttcaagatgcggcacatgccagaagtgccggtccgaattcgaattggccttcactcagggccggttgttgctggagtggtgggcctcaccatgcccagatactgcttgtttggagacactgtgaacacagcttctcggatggaatctacaggcttaccttatcgcattcatgtcagtctcagcactgttacaattcttcaaaatctgagtgagggctatgaagtggagcttcgaggaagaacagagctcaagggcaaaggcacagaggaaaccttctggctgattgggaaaaaaggcttcatgaagccccttcctgtgcccccaccagtggacaaagatgggcaagtgggccatggcctgcaaccagtggagattgcagccttccaaagaagaaaagcagaaaggcagttggtgagaaacaagccataaggggcaaagggctccaggatttgaatcttctcttggtgaggcaatgggaaagctcacttcagttcaagaaattgttctgcctgggcaagaaatta

SEQ ID NO: 139438 - DNA, 1874 bp, Homo sapiens
  Payload ID: 7335
  Gene Symbol: GUCA1A
  Gene Name: guanylate cyclase activator 1A (retina)
  Uniprot ID: P43080
  ENST ID: ENST00000053469
  CDS Start-End: 616-1221
cagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgctaagagaa

SEQ ID NO: 139439 - DNA, 1575 bp, Homo sapiens
  Payload ID: 7335
  Gene Symbol: GUCA1A
  Gene Name: guanylate cyclase activator 1A (retina)
  Uniprot ID: P43080
  ENST ID: ENST00000372958
  CDS Start-End: 324-929
tgcttctctaagccttgttctattttcaactcttttctccagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgct

SEQ ID NO: 139440 - DNA, 2233 bp, Homo sapiens
  Payload ID: 7335
  Gene Symbol: GUCA1A
  Gene Name: guanylate cyclase activator 1A (retina)
  Uniprot ID: P43080
  ENST ID: ENST00000394237
  CDS Start-End: 977-1582
acctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcaggttcaatttctacacctcccagtactccaactccctgaaccccttctacactttgcagaagcctacctgtggctacctgtaccgccgggacactgaccacacccgcaagcgctttgatgtgcctcctgccaacttggtcttgtggcgctcctaggcctgagccaaacggaagcccccgacccttcaccctcacccctgtgacctcaggtccccaaggggaagggctgctcactgcaggaggagtgacctatattcgggctaagacagctgtgccatgcccacctattgacaatgataaagggaggtctctcttctcagcagcagttaaagtttgtccttcctttccctggcatctgaatgggtggctgtggggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgctaagag

SEQ ID NO: 139441 - DNA, 801 bp, Homo sapiens
  Payload ID: 7335
  Gene Symbol: GUCA1A
  Gene Name: guanylate cyclase activator 1A (retina)
  ENST ID: ENST00000418175
  CDS Start-End: 538-801
agtatcctgccaagagtcctccctgaccaccagaagttccacctcaccatcaagaaaggccctggtccaggatgtgcaaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtg

SEQ ID NO: 139442 - DNA, 1921 bp, Homo sapiens
  Payload ID: 7335
  Gene Symbol: GUCA1A
  Gene Name: guanylate cyclase activator 1A (retina)
  ENST ID: ENST00000541991
  CDS Start-End: 658-1275
agtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccagtttcctcatcaataccaaaagacggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgct

SEQ ID NO: 139443 - DNA, 1113 bp, Homo sapiens
  Payload ID: 7336
  Gene Symbol: GUCA1B
  Gene Name: guanylate cyclase activator 1B (retina)
  Uniprot ID: Q9UMX6
  ENST ID: ENST00000230361
  CDS Start-End: 97-699
ggaaagggaggaagagggccctagttggagagatccatcagcagaagccagggaggagatacagacccttgctccctgatgctcctcagggctagcatggggcaggagtttagctgggaggaggcggaggcagctggcgagatagatgtggcggagctccaggagtggtacaagaagtttgtgatggagtgccccagcggcacactctttatgcatgagtttaagcgcttcttcaaggtcacagacgatgaggaggcctcccagtatgtagagggcatgttccgagccttcgacaagaatggggacaacaccatcgacttcctggagtacgtggcagctctgaatctcgtgctgaggggcaccctggagcacaagctgaagtggacattcaagatctatgataaggatggcaatggctgcatcgaccgcctggagctactcaacattgtggagggaatttaccagctgaagaaagcctgccggcgagagctacaaactgagcaaggccagctgctcacacccgaggaggtcgtggacaggatcttcctcctggtggatgagaatggagatggccagctgtctctgaacgagtttgttgaaggtgcccgtcgggacaagtgggtgatgaagatgctgcagatggacatgaatcccagcagctggctcgctcagcagagacggaaaagtgccatgttctgaggagtctggggcccctccacgactccaggctcacccaggtttccagggtagtaggagggtccctggctcagcctgctcatgcccactcttcccctggtgttgacttcctggcaccccctgtgcagggctgagtggggatggggaagggctgctgggtttgaagtggccaacagggcatagtccattttggaggagtccctgggatggtgaagggaattcagttacttttcctgttcagccgctcctgggaggactgtgccttggctgggtggttgtggggctcccacagtttctgggtgttctcagttggaagcaagagccaactgaggggtgagggtcccacagaccaaatcagaaatgagaacacaaagactggtaggaggcaggggtgggagggtgttgagactgaagaaa

SEQ ID NO: 139444 - DNA, 982 bp, Homo sapiens
  Payload ID: 7337
  Gene Symbol: GUCA1C
  Gene Name: guanylate cyclase activator 1C
  Uniprot ID: O95843
  ENST ID: ENST00000261047
  CDS Start-End: 134-763
ttgctgtaagaggtttagagtagctttctgagggcatatgttagccttcagttttagtgaggagtaagggactaaatccagcaaaaacttaagtgaaaacaacctgaggaaaagctgtagactgtgagtcaagatggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggggaattgactttagaagaatttatcaatggcatggcaaaagatcaggatctcctggagattgtttacaagagcttcgacttctccaatgtgctgagagtaatctgtaatgggaagcagccagacatggagacagactcctccaaatctcctgacaaggctggtctagggaaggtgaaaatgaagtagctgtgagaatacctgtcccagctatcaatgagcacaacatttcagtagagaagaaatagaatcttccccatgtacatgctgttgatttcaggtctttgttataattcatataggcttgtgaatatagcacttattttaatccagtagagacttgcataaagatcctaaacagatgcattgttgcttttctgtgctgtctctgcagattaaaacataatg

SEQ ID NO: 139445 - DNA, 900 bp, Homo sapiens
  Payload ID: 7337
  Gene Symbol: GUCA1C
  Gene Name: guanylate cyclase activator 1C
  ENST ID: ENST00000393963
  CDS Start-End: 1-591
atggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggtaatggagctactctctactggatcacttttcctacaaagggaattgactttagaagaatttatcaatggcatggcaaaagatcaggatctcctggagattgtttacaagagcttcgacttctccaatgtgctgagagtaatctgtaatgggaagcagccagacatggagacagactcctccaaatctcctgacaaggctggtctagggaaggtgaaaatgaagtagctgtgagaatacctgtcccagctatcaatgagcacaacatttcagtagagaagaaatagaatcttccccatgtacatgctgttgatttcaggtctttgttataattcatataggcttgtgaatatagcacttattttaatccagtagagacttgcataaagatcctaaacagatgcattgttgcttttctgtgctgtctctgcagattaaaacataatgattacactaaa

SEQ ID NO: 139446 - DNA, 633 bp, Homo sapiens
  Payload ID: 7337
  Gene Symbol: GUCA1C
  Gene Name: guanylate cyclase activator 1C
  ENST ID: ENST00000471108
  CDS Start-End: 5-490
caagatggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggtaatggagctactctctactggatcacttttcctacaaagtaggagatggtggtagtggggagtgttatttagacaaaagcaggaaccattcaagagaaccctagttgtgacttaggcttcataatgggaccaatccaatgttctcagtatgattcaattgagtaaatatttattgatcatattca

SEQ ID NO: 139447 - DNA, 569 bp, Homo sapiens
  Payload ID: 7338
  Gene Symbol: GUCA2A
  Gene Name: guanylate cyclase activator 2A (guanylin)
  Uniprot ID: Q02747
  ENST ID: ENST00000357001
  CDS Start-End: 7-354
gctgccatgaatgccttcctgctctccgcactgtgcctccttggggcctgggccgccttggcaggaggggtcaccgtgcaggatggaaatttctccttttctctggagtcagtgaagaagctcaaagacctccaggagccccaggagcccagggttgggaaactcaggaactttgcacccatccctggtgaacctgtggttcccatcctctgtagcaacccgaactttccagaagaactcaagcctctctgcaaggagcccaatgcccaggagatacttcagaggctggaggaaatcgctgaggacccgggcacatgtgaaatctgtgcctacgctgcctgtaccggatgctaggggggcttgcccactgcctgcctcccctccgcagcagggaagctcttttctcctgcagaaagggccacccatgatactccactcccagcagctcaacctaccctggtccagtcgggaggagcagcccggggaggaactgggtgactggaggcctcgccccaacactgtccttccctgccacttcaacccccagctaataaaccagattccagagt

SEQ ID NO: 139448 - DNA, 597 bp, Homo sapiens
  Payload ID: 7339
  Gene Symbol: GUCA2B
  Gene Name: guanylate cyclase activator 2B (uroguanylin)
  Uniprot ID: Q16661
  ENST ID: ENST00000372581
  CDS Start-End: 31-369
gacagcggcagggggaacccagggagcgcgatgggctgcagggctgcatcagggctcctgccaggagtggccgtggtcctcctgctgctgctgcagagcacacagtcagtctacatccagtaccaaggcttccgggtccagctggaatccatgaagaagctgagtgacctggaggcacagtgggcacccagcccccgcctgcaggcccagagcctcctgcccgccgtgtgccaccaccctgctctgcctcaggaccttcagcctgtctgcgcctcgcaggaggcttccagcatcttcaagaccctgaggaccatcgctaacgacgactgtgagctgtgtgtgaacgttgcgtgtaccggctgcctctgagatagccctgggtaccctgagcccaccagggacacctcgcccttcagcccaccaccctggcaggcttccatccccgtccatgctcaagatgggtccctggccaccatggtcatcaccacccttccagggcctgagcagctggatctggtacaaagcaatcggacatagagttggagggggaggcccctgaggcagcccagctcctgaataaagattctacaacacacg

SEQ ID NO: 139449 - DNA, 1084 bp, Homo sapiens
  Payload ID: 7340
  Gene Symbol: GUK1
  Gene Name: guanylate kinase 1
  Uniprot ID: Q16774
  ENST ID: ENST00000312726
  CDS Start-End: 242-835
gaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaa

SEQ ID NO: 139450 - DNA, 940 bp, Homo sapiens
  Payload ID: 7340
  Gene Symbol: GUK1
  Gene Name: guanylate kinase 1
  Uniprot ID: Q16774
  ENST ID: ENST00000366716
  CDS Start-End: 60-653
cagcagatggggactagaggccgcactgctatccacagcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaatgagtggaatgtggccccaaggttggtgg

SEQ ID NO: 139451 - DNA, 1275 bp, Homo sapiens
  Payload ID: 7340
  Gene Symbol: GUK1
  Gene Name: guanylate kinase 1
  Uniprot ID: Q16774
  ENST ID: ENST00000366718
  CDS Start-End: 428-1021
cgcctcgcctgagttgtgtccaaggtgtgcgtgtggccaggggtccatccgcttccctctagcccagcccctgaacacagctgcagtgcacggccccactcctcagctctgctccccatcccaactcgaagacgctgccctggccctgtgtgtgcagctcatgtggactgggagggcagggcaggtgcaggtcttggggcaagagctggagctgtcttttccttcctgcacagccgcagagcaggtggatggggctgcttccctgcaagggcccagggccaggccccctggggatttattcgtggcttagaagggtggggccagaagcaggcgtagtggggattagggactcagcacccccagctctcagtccagcagacagacccaccccaggctgactacagaggctgcacctcagcaaacaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactcca

SEQ ID NO: 139452 - DNA, 689 bp, Homo sapiens
  Payload ID: 7340
  Gene Symbol: GUK1
  Gene Name: guanylate kinase 1
  ENST ID: ENST00000366721
  CDS Start-End: 35-634
tgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggagggataccacgaggaacccgaggcccggcgaggagaacggcaaagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcat

SEQ ID NO: 139453 - DNA, 850 bp, Homo sapiens
  Payload ID: 7340
  Gene Symbol: GUK1
  Gene Name: guanylate kinase 1
  ENST ID: ENST00000366722
  CDS Start-End: 69-797
gctggccgggctggctgcggccgccctgggccgggccccaccggacgcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctgcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtgg

SEQ ID NO: 139454 - DNA, 845 bp, Homo sapiens
  Payload ID: 7340
  Gene Symbol: GUK1
  Gene Name: guanylate kinase 1
  ENST ID: ENST00000366723
  CDS Start-End: 2-709
gatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcccggctgggctggaaagctgtcccacagccgcagtgaggacagccgcaggcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtgg

SEQ ID NO: 139455 - DNA, 873 bp, Homo sapiens
  Payload ID: 7340
  Gene Symbol: GUK1
  Gene Name: guanylate kinase 1
  Uniprot ID: Q16774
  ENST ID: ENST00000366726
  CDS Start-End: 97-690
agaggtggccccggatgctgcggcgcccgctggccgggctggctgcggccgccctgggccgggccccaccggacgcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcc

SEQ ID NO: 139456 - DNA, 842 bp, Homo sapiens
  Payload ID: 7340
  Gene Symbol: GUK1
  Gene Name: guanylate kinase 1
  Uniprot ID: Q16774
  ENST ID: ENST00000366728
  CDS Start-End: 14-739
gaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaa

SEQ ID NO: 139457 - DNA, 937 bp, Homo sapiens
  Payload ID: 7340
  Gene Symbol: GUK1
  Gene Name: guanylate kinase 1
  Uniprot ID: Q16774
  ENST ID: ENST00000366730
  CDS Start-End: 201-794
cttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaac

SEQ ID NO: 139458 - DNA, 990 bp, Homo sapiens
  Payload ID: 7340
  Gene Symbol: GUK1
  Gene Name: guanylate kinase 1
  Uniprot ID: Q16774
  ENST ID: ENST00000391865
  CDS Start-End: 76-732
agtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaa

SEQ ID NO: 139459 - DNA, 656 bp, Homo sapiens
  Payload ID: 7340
  Gene Symbol: GUK1
  Gene Name: guanylate kinase 1
  ENST ID: ENST00000453943
  CDS Start-End: 6-656
cccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggc

SEQ ID NO: 139460 - DNA, 865 bp, Homo sapiens
  Payload ID: 7340
  Gene Symbol: GUK1
  Gene Name: guanylate kinase 1
  ENST ID: ENST00000435153
  CDS Start-End: 48-865
ctggccgggctggctgcggccgccctgggccgggccccaccggacggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcagcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtgga

SEQ ID NO: 139461 - DNA, 1012 bp, Homo sapiens
  Payload ID: 7340
  Gene Symbol: GUK1
  Gene Name: guanylate kinase 1
  ENST ID: ENST00000412265
  CDS Start-End: 253-1012
tgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgagg

SEQ ID NO: 139462 - DNA, 1593 bp, Homo sapiens
  Payload ID: 7341
  Gene Symbol: GUCD1
  Gene Name: guanylyl cyclase domain containing 1
  Uniprot ID: Q96NT3
  ENST ID: ENST00000398245
  CDS Start-End: 181-900
ctggaagggctggggcggcgcttggggcggcccagccgccgcctcccgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgaccgaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgc

SEQ ID NO: 139463 - DNA, 1606 bp, Homo sapiens
  Payload ID: 7341
  Gene Symbol: GUCD1
  Gene Name: guanylyl cyclase domain containing 1
  Uniprot ID: Q96NT3
  ENST ID: ENST00000404664
  CDS Start-End: 111-998
cctttccccagtgttgagcgcggtctcgcctccgcttcctcctcactccgcctgccggctgggaaactagggcaccagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccaggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgaccgaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccct

SEQ ID NO: 139464 - DNA, 865 bp, Homo sapiens
  Payload ID: 7341
  Gene Symbol: GUCD1
  Gene Name: guanylyl cyclase domain containing 1
  ENST ID: ENST00000402766
  CDS Start-End: 135-548
cgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagcctt

SEQ ID NO: 139465 - DNA, 773 bp, Homo sapiens
  Payload ID: 7341
  Gene Symbol: GUCD1
  Gene Name: guanylyl cyclase domain containing 1
  ENST ID: ENST00000407973
  CDS Start-End: 391-773
agtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaa

SEQ ID NO: 139466 - DNA, 3482 bp, Homo sapiens
  Payload ID: 7341
  Gene Symbol: GUCD1
  Gene Name: guanylyl cyclase domain containing 1
  Uniprot ID: Q96NT3
  ENST ID: ENST00000407471
  CDS Start-End: 192-914
agattcgagacctggaagggctggggcggcgcttggggcggcccagccgccgcctcccgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaagcccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccactagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaa

SEQ ID NO: 139467 - DNA, 895 bp, Homo sapiens
  Payload ID: 7341
  Gene Symbol: GUCD1
  Gene Name: guanylyl cyclase domain containing 1
  ENST ID: ENST00000447813
  CDS Start-End: 99-509
ggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatgg

SEQ ID NO: 139468 - DNA, 3613 bp, Homo sapiens
  Payload ID: 7341
  Gene Symbol: GUCD1
  Gene Name: guanylyl cyclase domain containing 1
  Uniprot ID: Q96NT3
  ENST ID: ENST00000435822
  CDS Start-End: 326-1045
gcgcgaggattgggcgagagggtggggccactcaacgctgaggcggcgaatggccggagcagacttaaatcaagaggctggggacctctaagatcaaagtttggggcggggcctaaggagggggcggggcctccagattcgagacctggaagggctggggcggcgcttggggcggcccagccgccgcctcccgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgaccgaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaagcccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccactagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaa

SEQ ID NO: 139469 - DNA, 3584 bp, Homo sapiens
  Payload ID: 7341
  Gene Symbol: GUCD1
  Gene Name: guanylyl cyclase domain containing 1
  ENST ID: ENST00000621833
  CDS Start-End: 111-1001
cctttccccagtgttgagcgcggtctcgcctccgcttcctcctcactccgcctgccggctgggaaactagggcaccagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccaggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaagcccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccactagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaatggtggtagcccctg

SEQ ID NO: 139470 - DNA, 4449 bp, Homo sapiens
  Payload ID: 7342
  Gene Symbol: GUF1
  Gene Name: GUF1 homolog, GTPase
  Uniprot ID: Q8N442
  ENST ID: ENST00000281543
  CDS Start-End: 195-2204
caagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacttgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactgacttgagagctgtctcagatattttgagcttacagttattgtgaaatcattttaattataaattaagtggagatttacttaaaatcatgtgtagaagtagcctgtgatatagtcctagatacatacattatcatcttatgtatcttccctccctcttccaggttctgataaaaacagatgaaatctgaaagaccatgacagtagtattttgaaaatgacagtatttgaaattaaaaaattgtaaaag

SEQ ID NO: 139471 - DNA, 1219 bp, Homo sapiens
  Payload ID: 7342
  Gene Symbol: GUF1
  Gene Name: GUF1 homolog, GTPase
  ENST ID: ENST00000513775
  CDS Start-End: 130-426
ttgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggag

SEQ ID NO: 139472 - DNA, 3347 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000359135
  CDS Start-End: 513-1427
aaaggaaggggcggcgtccacatggttacccttctgctgcgcgggtcaagtagcttcttctggagggcgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttatttctccagtgcgtttttatgaagatctggttgaaaattgtatttctatgtaaactcaacgatatgtttggttttcctgaaaataaatgattttaaataaattaaa

SEQ ID NO: 139473 - DNA, 3544 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000409580
  CDS Start-End: 715-1629
tggagggcgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaaggtagagtaaggaagacttagctggtgttgggcttggcgggtccacttggtacgctgggcaaactccaacagcaagaattgaagacttaagggtttgagcagatggttttctacctaaattgaataattcaattacgtattctcagctagcatggatttgggtcatggaattaaagtagaaacgtatccggcatgacttctttgtgcttatcaaaagtgatcctgataaacagatcttgctctttcatgtaaagaagtaaaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttatttctccagtgcgtttttatgaagatctggttgaaaattgtatttctatgtaaactcaacgatatgtttggttttcctgaaaataaatgattttaaataaa

SEQ ID NO: 139474 - DNA, 1242 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000409637
  CDS Start-End: 446-949
cgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggatt

SEQ ID NO: 139475 - DNA, 1376 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000409830
  CDS Start-End: 462-1376
cccggccgggagcgacccggagtccccagccccgcgtcccagctgccgccagcgccagttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctga

SEQ ID NO: 139476 - DNA, 583 bp, Homo sapiens
  Payload ID: 7343
  Gene Symbol: GULP1
  Gene Name: GULP, engulfment adaptor PTB domain containing 1
  ENST ID: ENST00000409927
  CDS Start-End: 378-583
gagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgaggtacggagatttatctaggctcttccctggctgcgaacccaggctccctccagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaa

SEQ ID NO: 139477 - DNA, 1932 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000409609
  CDS Start-End: 748-1662
agactgagctcagtagccaggcatgaaagagactgggcaagttgcaggggctaattggaaaggggctgtcggttgcacttggggtttaaacaagaggtttcttttgcaatgagaatttttaggtggctaagatcagtcttcttggcaaaaaaataaactaagcatagagtgcagttggatatgaccgaggaaattacaaaaagggctccaggagcaaagtctgaactttccttatcagtgttgcagtggaatagctgggggcctgatgctgtttgtgctgatcatactttgcaaatgcccacactttgttgctgtttgtctccttggacgaggtttgctgcaacttcaattccttgacttcggccttactttgttttcatagcagcaagaattgaagacttaagggtttgagcagatggttttctacctaaattgaataattcaattacgtattctcagctagcatggatttgggtcatggaattaaagtagaaacgtatccggcatgacttctttgtgcttatcaaaagtgatcctgataaacagatcttgctctttcatgtaaagaagtaaaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaat

SEQ ID NO: 139478 - DNA, 1595 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000410051
  CDS Start-End: 393-896
gcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagagaaaaaaaaaaaa

SEQ ID NO: 139479 - DNA, 2643 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000409843
  CDS Start-End: 670-1545
attccaccctccacccacctccggttccgcgtgcacgcgcgagatagtccagtgggcccacagataacgaccatcagagattaaagaaggaaagtcagcgagcttgaacacaggcgtcccgtgtggaaatgtccaaggagaccgccagaagtgcgcaagccggagtcggctagagtttccttctcaccgagagggggagcccggcgttcccggccgggagcgacccggagtccccagccccgcgtcccagctgccgccagcgccagttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcagcgccagagatggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttcc

SEQ ID NO: 139480 - DNA, 983 bp, Homo sapiens
  Payload ID: 7343
  Gene Symbol: GULP1
  Gene Name: GULP, engulfment adaptor PTB domain containing 1
  Uniprot ID: Q9UBP9
  ENST ID: ENST00000409805
  CDS Start-End: 299-904
aaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaaggctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagatagg

SEQ ID NO: 139481 - DNA, 767 bp, Homo sapiens
  Payload ID: 7343
  Gene Symbol: GULP1
  Gene Name: GULP, engulfment adaptor PTB domain containing 1
  ENST ID: ENST00000433052
  CDS Start-End: 1-569
aaaaccaactgagaataactcaagtatcagcacctccactgctgcacaatatgtctgatcatgaacaacatgtgtttcagagatgctcatcctctttctggcgtagtaatggtgattcatctccctgtctcaatatttcttccatctctgtcactcctatcaactcgcctgattccagactatcactgggactgttaataccaccaccttctaaatgtggctttcccaagccagtcagtgagagcagcatcccaagacctcatgcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagt

SEQ ID NO: 139482 - DNA, 7427 bp, Homo sapiens
  Payload ID: 7343
  Gene Symbol: GULP1
  Gene Name: GULP, engulfment adaptor PTB domain containing 1
  ENST ID: ENST00000451191
  CDS Start-End: 1-443
tagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggtgactattttgatagactggcccataaatgatttatttcattttgatatgggacaaagagaatgttatgtaccaaaactatggtttccttcaattattttcgctataaaaactcgcttaaaataattactttaaaataataatgtacagttagtcctaaaaatactcctacatatgctaaggataaggttgttggttttttaaatggttcaatttataatgtcaataagatggttcattttttaaatacaaaatggcatggattctaatggttcattgttctgaaatctagagttaaacagtcactgcattagatttataagatttgatctcagtcttaacaattatgaatttgaaaattgtaaatgggtagatgaaggaaaatctttgtaagagtgaaattattctctctgaaaagaagcattgtagctgtagttcataacttttgggcttttatttaaaaagcaaacaaccagtgacaacttatttaggaatgtagttcagttgggttttcatttctctctcttccttttacttttttgttctaaattggtctgaagtttacagaaattggttttaaatgctttgcactatgggccatgatttaaaaatagtcttataaaccctagaataaagtcttctctttatatttgccctttacattttggtgaagttattatatcctatttttcatcaaaaagtttatatatggtagaatccagacagacaccaattatatgaagctgattgagaagagacaatgaagacactaaagtaaggagaaggaggtatttttgtttattagtcttgggttaatacattaattctctatgcctcacttcctagaaaaaacaattatgggtgaacactgatctatcactgataattgcaatccttcttagaaagttaatttaaatgcccttttactcatttttgactgcagctgtgtagctatcttattttctaggtagtacatgaattcattattgttctagatgtaataacatgcctgaatttaaaagttgaattacttaacatatgtcttgaggttttcaaagaatctattaaaacagtgtttctcaagttgaatgattcttaatccccttttacataaaaattgttttagatccttagtattaacttacaatttttaaatattgacaaaaatgttataaacaacttgtccttatggtttttataaaattatgaattcaataaattataaattaaatgaaagccaaattgcaacaccaatacaggacggatgatcttatttggttaaagctaaaaccaccttatcaaatttctattgatttcaacatgtattctatctgatggcacagatttcctagttcttttctatatttcaaacgctatgaaactttcaaatggcgcatgataatttagcaagaatgctgtatttcatatgaaatcaattccttttcttttacattagttttacccattggacatgtactatctggtactaatgcttttgtagtaacaaagaaatatttatgtggtagtatttattctcaagggttgcacaggtcatacagagtacttctctaaaaattttttagattttcccaaaattggaaaaaaaattatggagttttaaggataagcctctatttccagattttgttgaaaccaagtgtgagacacaatgtattgggatgattgagtgatggtgacactcaatgttaaaccgtggtgtttttgcttttgctgtttctaatattttcttaatgtctttttaaattctttactgctttcatggtgggtagcgccagagatggttggtatattatttttataataattttaaacaacttacaaatttttaaagctgaaaccttaaaatttgcatgccttatttaataaaaattcaaacaacagcttcatatgggtatatctgataattagttatgtttagagaggttttataaaccacattttaagattatttttcagtgacttagtcactattgcattgttcacttcattgtttcctttcttttctttttttttttgaggcagagtctcactctatcgccctacccaagctggagtgcagtggcatgatcttggctcactgcaacctccaccgcccgggctcaagcaatcttccctcctcagcttcctgagtagctgagactacaagtgtgcactaccacgcgtggctaatttttgtattttttgttaaaaacagggtttcatcatgttgtccagactgggcttgaactgctgggctcaagcgatctacccacttagacctcccaaagtgcttggaccacaggcatgagccaccatacttggccatgattgtttcttttagtccaatatttacttgcaaggtcactttaacaaaagtaaaataatattttcttcatctaaagtctatgatggcttttattattaatcgtgctagcctaatgaatctaatgcagacatttagctatctttgcatatcatataaaaacttaatatagtacaatgggttgtgaacaccatattgagttaataagcctagtgagacatttagttttcatctttcatttacagagtattgtgactaagctatttttaagagaatcgaattattaagtttgaaatcacagaaacatctcatgcatgtaagcatttatgcagaaatgttagaccatatttcagtataagcagttagaaaattaaacatctatttgaaatcaataatgtagctatttgatttgacataatttaaactgtccagtacatgtcaccaacaggaaaataagtggaatagtattgatagcccacactgtaacatgtgagctataataatttaatacattaaaaaacaagcatggcaagttcatgaatgatgaaagaatcatgtatgagtggtgttaagtcagctagctagtactctgggagaagatcaatgtactgctgaaacttacagcaaatgccgagataaatttcagaagtaatcaacattttaaaatatttaaaatattattgaatattcatcagacttttgaattgaaaagaaaattttataaggaaaagaaaaatacggacatatagtatccaattttttaaaatttactgtctaaaaatatataaatacattacatatacataattaaagcaattagacaaatggctaggaaactaaagaatcaacagataaataaaaaagcactagttcacaaaagaagaccacaagtggcttacacatatgtagacatgttctgtctaatcaaagtaaacatataaatcaaataaagaactgtaatgctattttaatctagcagattattttttaaactaataatcaatcaatacaactgaaagtgtgataaaacaagcactgtaaattgttggcagtccagagttagttcagaggtaactatggcctagcagtctctttaaagggtagcttgttattaatacttttatttctgtttgatatcaaaactttaaagcaatctattctgatgaaaaaataagtatgaatgtgttcaatctctgcgaataaaaatacctagtcaacattattcataattttaaaatgctgaacgattttttttcaaatcaacgtaaaatgcatttttacgatggaaacaatcataaaaattaatagcattttatatagtcataataaattagttttgtgggaatttaaaataatcagggtctgcaaagatgaaaagaggaagatagaaaactatatgtaatatattacttacataagaaaattatatggcataaatatatattcatattatcattaaaatcatttttaaaaatgtatagatagaaaaaaagacatacctcaaaatgtagtgatttttctttccttgatatgcttttctatttcaaaataagaaaattcatcaaaatctttcgtataaaaagcatatggtgaataatactttaattatttaatcattcttttgtgtgacgttagcttatgataattcccatcactacataagtaaataaagtctcatttttattaagaagtttgaagctcaacaggtgtgggaaattttatctgaggaagaaagaaaatcaagaaaccttataatatgtaaggatccttaaaaagtcaatatggagatagatattattgtaagtcatatactaacactttattattaaaatagtgattgacctctgttttactttggctgctattctgcttttccaatattgataacacattgacaaatagtattttcagggtaattgaagtgatactggtttactagcagaatgaactgataaaatttaaaagtaccgtatggtatcaaacatttccacatgtaactctctttctatctgtcattatctatcaatgtatcatctatttaccatttgtaatataccagaagatgacataatatacagatcttcagatatccaaataaaataattttaaagaaaagtttacttacagtattttagtttaaagtatttatttttctaagtatttgctggctgtttgaaaaatataaataaatatggcaaaatgtattttgtgataagaatagatttttaaaaaataatgataagtagtctcatatttactcaactaaataaagattgtattccaagtactggaaagacattttgaaaaactttcacaatgattacatcactgtaattgctatatagtagtagtctctgtgctgtaaacataaagaatattctttgaacattaataacaaataaagtatggcttacagctttgtaactaccttcctcctctatatgatgatgtttacattggatttatagaaagataagaacatttacataattattctaaataaaagtaatttggagagatgcaaaaagatacccaattagctaacatacaagtagatatagtcagtccaattaaataaaacacccaaagcagaggtgaaaaccaatggttacctttaggagacattttgttttctttaggaatacactgctatctgcatattatttgccaataatgtgttgcatggccactccaaattacaaattacctttctgaaacatttcagttctgttagtaagaaaaaaaaggtagagtatgtagagagcactaccacatttgcttctacaaggagacctacaatgtaacctccactttcattgatcagtgcaagtctgtgcttttcatctttttgtaggccaatgtgtatagatttacaggaaagggtaggaatggggagaggtggcaagactggagatggcccacagttcaattatcttatgcaataaaaaaaaaagagattggagtgaaggaggacagactcctatgccattattttaattcaaaatcttggtggaaaaacactttcttagcaattgtgttcttatactcaataaatcatagacaacttaacttctaaaatatgcaaggaagagtaggagtcaaagaagccagtccgctacaagcaacagcaaggctagtaggggaagttttctccatggcaaagtaatctgcagttgtgtgttccacagaggatacggcattgcatttaaaagaagtattttacccgggctctggtcagtgctaaccaggaataaggtgaaaatcatcaggctatcttgaacctctcatcaatttgaagcctaactatcttaataatatttaaattaataataatttttaaagctaacagatttcatttacaatagaatgatgtagtaactagccttttctgaaaaagaaacctttatcttaattttatgttttctcttctgtctctcatgcatgctaacctcacatagatttaaaacattaaagtgttaatgggtctgaaagaactaccagtgctatacacctatataaaaattcagcaagtcaacatttgacatatagttatttattagttgatcaaagcatgaatatttcaactttagtgcatagtcttttttattcactgattttattttgctgtaagcatttcagatattaattattttattctgttttacaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttcc

SEQ ID NO: 139483 - DNA, 1833 bp, Homo sapiens
  Payload ID: 7344
  Gene Symbol: GVQW1
  Gene Name: GVQW motif containing 1
  Uniprot ID: Q8N7I0
  ENST ID: ENST00000451672
  CDS Start-End: 277-864
gtacaggaggtcggccagcagtctctgcctctgtgggggcctgctcatcacacagtagctgccgggcggcctggatgagccacgcgtgcggctggcgaaaagcactgaggaagcacccgatgtcactcacatagccctgccaggcctggcgtgaggtgagcagcaccagctcggcatcgtcgaggacgcttcggtcagctccatgccatcctcgtacgagggagctagaagcagaggtagcccttgcgcagcatctcccggcagctcctgcccgccatgccaaacttcctcgggctgcacagggcccgcagcttcacagtcttgtgcttctggagcactgcagatgtactcaacgcctctgggccccgcaggcagtggcacccgctggccagctgctcaagctggtccaggccccagtcacagggctctacaccaggtgtgctctgcaaaactggcatgggccgggaaccgatcccagaaactcagtgccattttgctaacagcatgtgttcacttcacgtctctgtgccatattttggtaattctcccaatatttcaaactttttcagatggagtctcgctctgtcacccaggcagtggtgcgatcttggctcactgcaacctccttctcccaggttcaagggattctcctgcctcagcctccccagtagctgggactacagacgtgcaccaagcccggctaatttttgtattttagtagagatggggtttcaccatgttggccaggctgatcttgaactcctcacctcagctgatttgcccacctcagcctcccaaagtgctgggattacaggtgtgagccaccatgcctggcctcaaactttgtcactattgttatattaatatttgttatggtaatctgcactcagtgatttttgatgttactactacaaattttaggggcaacacaaatcacacccatataagatagtgaatttaataagtaaatgttgtgtgttgtgactgttccaccaactggccattccccacctctctccctctccttggactgtcctattccctgagacacaacaatactgaaattaggccaatttaataacactacaatgacctctaactgttcaaataaaagaaagagctgcatgtttctcacttcatatcaaaagctacttggtaggctgaggcaggagaattgcttgaacctgggaggcggaggttgcagtgagtcgagatggcaccaccgcactccagcctgagtgacacagcaagaccttgtctcaaaaagaaaaaaaaaagatagtgattcctctgatggatctaggcaaagaaaatggaaaatcttctgggaaagaatttactatcctatatgccattaagaagatttgtgattaacaggaggaggtcaaagtatcaacatgaacaagagtttggaagaagttgatttcaactctcgtggatgactttgaggggttcaggaattcggtgcaggaaggaactcgatgtagtggatatagcaaaagaactagaattagaagtggagcctgaccatgtgactgaagtgcctccatcacatgataaagcttgatagatgagaaggtgctccttttggatgagcaaacaaagtggtttcttgagatggaatctgctcctggtgaagatgctatgaacattgttgaaatgacaacaaagaatttcgaatattacataatcttagttgataaagcagcggcatggtttgaaaggcctgactccaattttgaaagttatactgtgggtaaaatgctatgctatcaaacagcatctcatgctacagagatatctttcgtgaaaataaaagtcaatcgatgtggc

SEQ ID NO: 139484 - DNA, 2685 bp, Homo sapiens
  Payload ID: 7345
  Gene Symbol: GVQW2
  Gene Name: GVQW motif containing 2
  ENST ID: ENST00000624173
  CDS Start-End: 103-429
ctttagctgtaactccggcgggcgtgttgggtgtgtcgttttaggctctgtgacccaggagcaagacgcaataagcgggtgcagtggaggtagaaacgggaaatgcagtaccctttccggaagctactccgcccctcgacagagtcttgctgtgtcgcccaagctagagtgcagtggtgtcatctgggctcattgcaacctccgcttcctggattcaagcaattctcatgccacagcctcccaagtagctgggactacagatggaatctcactctgtcacccaggctggagtgcagtggcgcaatctcagctcactgcaacctctgcctccctgatttaagcgattctcctgcttcaacctcccgagtagctgggacgacaggcgcgcaccaccatgcccaggaacctgtggtgataaggaagatgtgagcctggagatacagaagctaccacatgaatgttaaaaatgaagctgacgcagcaaaaggcagtgccaaggaactaaaagaaaacaaattttgattacatttttggagttcctgggtcaagcagttcatgacactgaggcttttccgctacatgaataagtactttttctttcccgttaaagtgggtttgtgctggcttctctatcactcacaacaactggatactaactgaggcaacacttcctacctcttacacacattacacccataaaacagaaacaacatctaaaattagatttcaacacagctaccaagcagaaaagttcaaatcaacaagttatggataatgttttattgaaactacatttctcctcccaatgtgagtatggtgttggccaacatgttgcgtgttgattctgcttgcctttgtgtcctacatataggatgtgtactgtgtaatgaatcgtttcttcattatttttctcagcttgcatggttgcctccctcacctccattcacagagctcactgtgacagcattcaaccttgtcttggtacaagtgtgtaatttacataatagtcgcctctgtactttcctcagtaacttaaacaaagaagaccatcactcactgtgcttgcctttcaaattagatttgatatcaaattaaagtctcattttattaagtttctgaagccaaagtctttgacctatgaaagtatgtttcaattatgaatggaaaagagaagctttgtgttattaacaggaaaagaattcaagtgtgatggttgtgtcaatgccattgggacatgccagtagtcagtaactcaacagacaagcctgctagacctgctttactcatttgtggcgctgtttcttcactttctactgactcccacctgtgtttcataattctctacattgatatggtttattacttctcatagggatcttaaattaattgtgcaactcgttagagtctctttatgtaaaatacatagtcttcatactattagaatgttacaatctggacctaccaatgtgaacaagtgaaaaaatgtgctgtttattttaaccagcagtggtgttttagttagctatttatctccttatctcccaaatctcaaaaacactcagtagtttacaacatgaagcttttttttttttttttttgcttacaggtctgtgggtcagctgggataactctgcttcagactgtgggtcatcttggcttggcagactttaggttaaacataagactgtgtgtctcattctggggcccagactgaagggatagcagctagctggtgcatgctgtcttcgtggcaatcacaggggtgcgagaggcggagctgaaggacgcaagcacatttaagtcttttgcgtgtgtcatgttcaatgacattccatgtccagagccagctacatgggtggatcatgaatagaggggagaaatacaccccacccacttcagtgagctttaggtttacatgactgagggatggagggaagaattttggacaataatctcatctagtacatatggcttcaatttgtatgaaccctatctctactcctccaaccttctgatctcaactgctattgctaatatgacctgtgggagcgagaggactttctataactaggctgaattttaaaggaagagaatgacttccagatagcttattggctatcaatctaggagctcttacagctgagaaacattttgacccaaccctctggcttctttgttgatttatttttctgataaaattcatttttttaaatattaagctttaagaagtacatgtgttttaatgcagtaaaaaataaagcatatatgattcaatcatttgtaaatatacagtataactagtaagaaataaggggtctcattcacacccagatttataggagccagcactatgtgctcggtatataatagaagctcagttagtatttgttgattgaagtaccttttcttatttactaatgattattattaacagataataatttgggcctgaaatagacatttccttttttaatataattatatatatgtgcatatatatatcatcaatatcctctgactttattagtgactgttaaccacgtcgaaaaaagtaaaggtgtttattatgcatgcatagaaaaatgatatgtttgtgttcgctctttttaggaccaagaaaaaattattggttgctgttttctcagttttggttttttttaaaataaattttactgtgtgtatttg

SEQ ID NO: 139485 - DNA, 3229 bp, Homo sapiens
  Payload ID: 7346
  Gene Symbol: GIN1
  Gene Name: gypsy retrotransposon integrase 1
  Uniprot ID: Q9NXP7
  ENST ID: ENST00000399004
  CDS Start-End: 96-1664
aaaggacccgggtagttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaacggaaagtacacctaacacaatcaaagcatttctctccaaacactgtgctgaccacccaaacaattgggatgatcacctatcagctgtttcatttgccttcaatgtaactcacttggaacctactaaaaatacaccatattttcaaatgtttagtcgaaatccttatatgcctgagacttcagatagtcttcatgaagtggatggtgataatacaagtatgtttgccaaaattctagatgcaattaaagaagctgataaaataatggagaataagacaacttcactgggccagatggagaacaacaatttggatgaactaaataaaagcaagatcattgttaaaaagaaacccaaacaattaaatccatttcatttaaaagtgggtcatgaagttttaagacaaaggaaaaattggtggaaggatggtcgttttcagtctgaatgggttggtccttgtgtcatagactatattacagaaagtggatgtgctgtcctgagagacaacactggggttagactgaaaagacctatcaaaatgtcccaccttaagccctacataagagaatccagtgaacaagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaattgtttgtttagaatataaattcttaatgatatcttattcattaaaaacgttgtatagaagaagtatcttgacacattcttaatgactatattctgaaggtttattttatagttcttatctaaaattatgccacatttgaatatcagtatacgtacatatgaaggcaaaggaagcatgtaatatatagaattcactttttcttctaaaaagagaacaggcaaagcacccctacttcttgggaaataaattccagcccaaatctctcaaacctttgtatggttttggcaccgtttctaagttttaaattttctgaaattctctaccatttaaacagtaagtttgaactaccttgaatggaattgataaatactgaatcaactgtaacaatgaatgaaatgaagcttctttctgtttcattagaacttctaaaaacaagattgtatgaaaaaatatagggttatttaataggctttcacagaatattggtaatttcaaattatctaattggttagatagggtcaggattagggtctgaaactatgtattggttgggaaacaatttgtttattttcatactatatattaaagataaaaccatcgaccaggcatggtggcccacacctgtaatcccagcgctttgggaagccaaggcaggatgatcacttgaccccaggagttcgagaccagcctgggcaacacagggagaccctatctctacagaaaaatgtttaaaaattagccaggtgtggtggcacatgcctgcggtcccagctactcaggaggctgaagtaggagcattgcttgaccccaggaggtcgaggctgcagtgagccgcgctcatgccacagctctccagcctgggcgacagggcaagacctgtctcaacaacaacaacaaaagtatccgttaagaattttttctgcaatcataaaatcataaaataaccagtatcaaagattttaaactgtaatttctatgatattcataaatataaaataaatattgttcaataaatatttattctaaagcactatgaaaagaactgtgggaaaagtaaaagatgagtcaaacgtgtacctcattcttataaaggacttactgtctggtaggtaataaactatgtaagccatgtacagcacaagttaaggcatgctaaattgcagaagacaggtgtagataatgtacttagggaggcaaaaagagagaagttgtttttacataggaaatttgtgtttatccttatggaagaaggatcatttaagcttgaccttgaagaatgtataggatttggtaaatggatacaaaagaattaggggagaagtaatacacagaaatggaaaagtattgtaatgattcataaaaaggcagggcttcttgttgtctacactgcctcgggtataaagtgaagaagcaagataatgagggataaagctgaaaaggtaagtaggaaaccttatggagagctttgaatactattaaggattgatatgtgcccctcccaaaatttgtgttgaagtcttaacccccaccacctcaaaatgt

SEQ ID NO: 139486 - DNA, 3325 bp, Homo sapiens
  Payload ID: 7346
  Gene Symbol: GIN1
  Gene Name: gypsy retrotransposon integrase 1
  Uniprot ID: Q9NXP7
  ENST ID: ENST00000512248
  CDS Start-End: 53-295
acgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaaggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaacggaaagtacacctaacacaatcaaagcatttctctccaaacactgtgctgaccacccaaacaattgggatgatcacctatcagctgtttcatttgccttcaatgtaactcacttggaacctactaaaaatacaccatattttcaaatgtttagtcgaaatccttatatgcctgagacttcagatagtcttcatgaagtggatggtgataatacaagtatgtttgccaaaattctagatgcaattaaagaagctgataaaataatggagaataagacaacttcactgggccagatggagaacaacaatttggatgaactaaataaaagcaagatcattgttaaaaagaaacccaaacaattaaatccatttcatttaaaagtgggtcatgaagttttaagacaaaggaaaaattggtggaaggatggtcgttttcagtctgaatgggttggtccttgtgtcatagactatattacagaaagtggatgtgctgtcctgagagacaacactggggttagactgaaaagacctatcaaaatgtcccaccttaagccctacataagagaatccagtgaacaagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaattgtttgtttagaatataaattcttaatgatatcttattcattaaaaacgttgtatagaagaagtatcttgacacattcttaatgactatattctgaaggtttattttatagttcttatctaaaattatgccacatttgaatatcagtatacgtacatatgaaggcaaaggaagcatgtaatatatagaattcactttttcttctaaaaagagaacaggcaaagcacccctacttcttgggaaataaattccagcccaaatctctcaaacctttgtatggttttggcaccgtttctaagttttaaattttctgaaattctctaccatttaaacagtaagtttgaactaccttgaatggaattgataaatactgaatcaactgtaacaatgaatgaaatgaagcttctttctgtttcattagaacttctaaaaacaagattgtatgaaaaaatatagggttatttaataggctttcacagaatattggtaatttcaaattatctaattggttagatagggtcaggattagggtctgaaactatgtattggttgggaaacaatttgtttattttcatactatatattaaagataaaaccatcgaccaggcatggtggcccacacctgtaatcccagcgctttgggaagccaaggcaggatgatcacttgaccccaggagttcgagaccagcctgggcaacacagggagaccctatctctacagaaaaatgtttaaaaattagccaggtgtggtggcacatgcctgcggtcccagctactcaggaggctgaagtaggagcattgcttgaccccaggaggtcgaggctgcagtgagccgcgctcatgccacagctctccagcctgggcgacagggcaagacctgtctcaacaacaacaacaaaagtatccgttaagaattttttctgcaatcataaaatcataaaataaccagtatcaaagattttaaactgtaatttctatgatattcataaatataaaataaatattgttcaataaatatttattctaaagcactatgaaaagaactgtgggaaaagtaaaagatgagtcaaacgtgtacctcattcttataaaggacttactgtctggtaggtaataaactatgtaagccatgtacagcacaagttaaggcatgctaaattgcagaagacaggtgtagataatgtacttagggaggcaaaaagagagaagttgtttttacataggaaatttgtgtttatccttatggaagaaggatcatttaagcttgaccttgaagaatgtataggatttggtaaatggatacaaaagaattaggggagaagtaatacacagaaatggaaaagtattgtaatgattcataaaaaggcagggcttcttgttgtctacactgcctcgggtataaagtgaagaagcaagataatgagggataaagctgaaaaggtaagtaggaaaccttatggagagctttgaatactattaaggattgatatgtgcccctcccaaaatttgtgttgaagtcttaacccccaccacctcaaaatgtgaccttatttggaaatgaggttgttgcaagtgtaattagttgagatcatatttcaatagggtgggctctaatacagtattactggtgttctgataaaaggggaaaatttgaacacagactcaaggagaatgccatgtgaagataaaggcagagtttaagattatgtttctatatgccaagaaatgacagagattgccagaaaactaccagaagttaggggagaggcattgaatacatttttcctcattcctcagaagaccaaccctgtcaataccttatctcagacttttgcctccagaactgtgagacaataaaattctattgtttcagcca

SEQ ID NO: 139487 - DNA, 525 bp, Homo sapiens
  Payload ID: 7346
  Gene Symbol: GIN1
  Gene Name: gypsy retrotransposon integrase 1
  Uniprot ID: Q9NXP7
  ENST ID: ENST00000513747
  CDS Start-End: 34-276
tgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaaggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagaaagtctttatctcttgcaaggttcagtagtggcagatcatgactac

SEQ ID NO: 139488 - DNA, 1040 bp, Homo sapiens
  Payload ID: 7346
  Gene Symbol: GIN1
  Gene Name: gypsy retrotransposon integrase 1
  Uniprot ID: Q9NXP7
  ENST ID: ENST00000508629
  CDS Start-End: 42-710
cttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaattgtttgtttagaatataaattcttaatgatatcttattcattaaaaacgttgtatagaagaa

SEQ ID NO: 139489 - DNA, 2344 bp, Homo sapiens
  Payload ID: 7347
  Gene Symbol: H1F0
  Gene Name: H1 histone family, member 0
  Uniprot ID: P07305
  ENST ID: ENST00000340857
  CDS Start-End: 453-1037
cggatttgctcggcggaagaaacacagatggcggcggcgcagcgccattccgggccgggagcaggcagccagcagccctgtcctcaccgcggtccgcccgccgccgctaaatacccggatgcgccgcccaagcgccagacgcggagctgggaaaagggaggcagaggaggcggaggcagaggcagaggcagaggcagagcccgagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttctttgagttgggcacccgttgtgagagtttcagaacctttggccagcaggagagaggtggtagggagcagccagccggcaaaggaaggagggggaaaaaaaccgccaccgggctgacttccacctcccagtggtgagcagtgggggcccaaacccagtttccttctcatttttgttagtttgcgctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaatcgcgcacttgcgcgtcccccccccacccccttttttaaacaagtgttacttgtgccgggaaaattttgctgtctttgtaattttaaaactttaaaataaattggaaaagggagaaactga

SEQ ID NO: 139490 - DNA, 1300 bp, Homo sapiens
  Payload ID: 7348
  Gene Symbol: H1FNT
  Gene Name: H1 histone family, member N, testis-specific
  Uniprot ID: Q75WM6
  ENST ID: ENST00000335017
  CDS Start-End: 313-1080
taaggaactgtgggtagatggtttgcaggaccacatacacacacaaaatagccgactaaagaaagcggtggagatcgagatcagtaagtttgatttgggaacaaaaccctggagactctataggtaggtgactgttgggggtggacaggcgctgaagacttggattggtttagacctagaaggaagtggcatttgattggttattataagtgaaaagggcccctccccgggtgagatatgccagccccataattaggacctgaaaatctctgccaggcctgcctttgtgacgtggcccagtctacctcagctatggaacaggccttgactggtgaggcccaaagccggtggccccgcagaggcgggagtggggccatggctgaggcgcctgggcccagtggcgaatcccgaggacactcagccactcagctgccagcggaaaaaactgtcgggggaccatcgaggggctgctcaagctccgtgctcagagtgtcccagttggtgctccaggccatctccactcacaaagggctgactctggcagctctcaagaaggagctccgaaacgccggctacgaagtgcgcaggaagagcggccgccacgaagcgcccagggggcaggccaaggccacgctcctccgggtcagcggcagcgacgccgccggctacttcagggtctggaaggttcccaagcccaggagaaagccgggacgcgcgaggcaagaggagggcacgcgcgctccctggaggaccccagccgcgccccggagctcccggaggcgccgccagccccttcgcaaggcggccaggaaggccagagaagtgtggagacggaacgcgagggcgaaagccaaggccaatgccagggcgaggaggaccaggagggcaaggccgagagccaaggagccgccgtgtgccagagccaaggaggaagcgggagcgacagcggcagacgaggggcgaggacaggccgtgaaggaagacaccacgccgaggtcagggaaggacaagaggcgaagctccaagcccagggaagagaagcaggagcccaagaagcccgcacagcggaccatccagtagccaacgcgggctaaaaccgaccggacatctagcgggcaggggaagactccactaaagacttccacaaagacctcccctaaatctgaaggtcttcctgatccagttgggaatgcatcttgtgggagcagcttcactcccaccacggaccaatgcctttcccccataggccccaagaagagcggctgtcacactcattgaaatgaaatggacctctagacca

SEQ ID NO: 139491 - DNA, 1067 bp, Homo sapiens
  Payload ID: 7349
  Gene Symbol: H1FOO
  Gene Name: H1 histone family, member O, oocyte-specific
  Uniprot ID: Q8IZA3
  ENST ID: ENST00000324382
  CDS Start-End: 6-1046
gtctcatggctcctgggagcgtcaccagcgacatctcaccctcctcgacttccacagcaggatcatccaggtctcctgaatctgaaaagccaggcccgagccacggcggtgtcccaccaggaggcccgagccacagcagcctcccggtgggacgccgccaccccccggtgctacgcatggtgctggaggcgctgcaggctggggagcagcgccggggcacgtcggtggcagctatcaagctctacatcctgcacaagtacccaacagtggacgtcctccgcttcaagtacctgctgaagcaggcgctggccactggcatgcgccgtggcctcctcgccaggcccctcaactccaaagccaggggggccactggcagcttcaaattagttcccaagcacaagaagaaaatccagcccaggaagatggcccccgcgacggctcccaggagagcgggtgaggccaaggggaagggccccaagaaaccaagtgaggccaaggaggaccctcccaacgtgggcaaggtgaaaaaggcagccaagaggccagcaaaggtgcagaagcctcctcccaagccaggcgcagccacagagaaggctcgcaagcaaggcggcgcggccaaggacaccagggcacagtcgggagaggctaggaaggtgccccccaagccagacaaggccatgcgggcaccttccagtgctggtgggctcagcaggaaggcaaaggccaaaggcagcaggagcagccaaggagatgctgaggcctacaggaaaaccaaagctgagagtaagagttcaaaacccacggccagcaaggtcaagaatggtgctgcttccccgaccaaaaagaaggtggtggccaaggccaaggcccctaaagctgggcaggggccaaacaccaaggctgctgctcctgctaagggcagtgggtccaaggtggtacctgcacatttgtccaggaagacagaggcccccaagggccctagaaaggctgggctgcccatcaaggcctcatcatccaaagtgtccagccagagggctgaagcttagggccagaggcaggggcggaga

SEQ ID NO: 139492 - DNA, 881 bp, Homo sapiens
  Payload ID: 7349
  Gene Symbol: H1FOO
  Gene Name: H1 histone family, member O, oocyte-specific
  Uniprot ID: Q8IZA3
  ENST ID: ENST00000503977
  CDS Start-End: 131-754
gcgtcacagcaggaccaggcggctaagcagggagaagagccagaggggcgtcaggtgtctgatgcggtgtgctggcagttgaggggtgaagttagttcccaagcacaagaagaaaatccagcccaggaagatggcccccgcgacggctcccaggagagcgggtgaggccaaggggaagggccccaagaaaccaagtgaggccaaggaggaccctcccaacgtgggcaaggtgaaaaaggcagccaagaggccagcaaaggtgcagaagcctcctcccaagccaggcgcagccacagagaaggctcgcaagcaaggcggcgcggccaaggacaccagggcacagtcgggagaggctaggaaggtgccccccaagccagacaaggccatgcgggcaccttccagtgctggtgggctcagcaggaaggcaaaggccaaaggcagcaggagcagccaaggagatgctgaggcctacaggaaaaccaaagctgagagtaagagttcaaaacccacggccagcaaggtcaagaatggtgctgcttccccgaccaaaaagaaggtggtggccaaggccaaggcccctaaagctgggcaggggccaaacaccaaggctgctgctcctgctaagggcagtgggtccaaggtggtacctgcacatttgtccaggaagacagaggcccccaagggccctagaaaggctgggctgcccatcaaggcctcatcatccaaagtgtccagccagagggctgaagcttagggccagaggcaggggcggagagagaccgagcctctgccctagtttttattcttcaactaaccactgctctatttatttcattgtaagctatttatcaataaagacttttgtttctttttcctcacaa

SEQ ID NO: 139493 - DNA, 1507 bp, Homo sapiens
  Payload ID: 7350
  Gene Symbol: H1FX
  Gene Name: H1 histone family, member X
  Uniprot ID: Q92522
  ENST ID: ENST00000333762
  CDS Start-End: 376-1017
cgcgcacgcccagcgagttccagaggcgccagtggaagctgcggcggcggtgtctcgcgttcggcgggatttctcttcgctccggctcggcctaggtctacgtccccagctccagccgccggctcggactcggtctctgacccccaactcggtcccctagtccggccccggctccgggccccccaaccctcgctccggcccggcccggcccccaccccagccctgccgcccggccccaggcccggccgcggccgctcccgcctggagccgccgcgcgcccccagcccccctgcaccccctcggcccctcgccttcctcttcccggcgcggccccccggcttccgcgcgccgcccgccaccaatcctcttgctaccatgtccgtggagctcgaggaggccctgccagtgacgaccgccgagggaatggccaagaaggtgaccaaggctggcggctcggcggcgttgtccccatctaagaagaggaagaatagcaagaagaagaaccagccgggcaagtacagccagctggtggtggagaccatccgtaggctgggcgagcgcaacggctcgtcgctggccaagatctacaccgaggccaagaaggttccgtggttcgaccagcagaatgggcgcacctacctcaagtactcgatcaaggcgctggtgcagaacgacacgcttctgcaggtgaagggcaccggcgccaacggttccttcaagctcaaccgcaagaagctggagggcggcggggagcggcgcggagccccggcggccgccaccgccccggcccccaccgcgcacaaagcgaagaaggcagccccgggcgcggccggctcccggcgcgcggacaagaagcccgccaggggccagaagccggagcagcgctcgcacaagaagggcgctggcgccaagaaggacaaaggcggcaaggccaagaagacggcggccgccgggggcaagaaggtgaagaaggcggccaagcccagcgtccccaaagtgcccaagggccgcaagtgagcgtgtcggccggtcagagcggccggcgtgggcttttcggtgtttttgtttttctaccccaagtgacgtagattttgtacggctcacgccggccggggccgcgaggcctggtctgagcctcagggaggggccccgggtcctctcagtctttcccctcccccaacgatgtagcgtttttcgttgtttgctttaggtttttgaaacagccccggcgacgcctctattggctctcggccttggcaacggccgtcgtcatggttactggcccctaggcgccgatggccgaggccgcgcctgcccaccgggcggggtcgctggttggccgggcccaggcgcgcggggacgcggaggccgcgcatcctttcccagctccccaccctccttgcctttgggtgcgcgacaaacaatcgctccgggctcagggctgcgcggctcttcccttcattccatgggcctttttttgggcacaataaagcgtttaaacctttca

SEQ ID NO: 139494 - DNA, 2280 bp, Homo sapiens
  Payload ID: 7351
  Gene Symbol: HLX
  Gene Name: H2.0-like homeobox
  Uniprot ID: Q14774
  ENST ID: ENST00000366903
  CDS Start-End: 459-1925
caaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagagatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccagcagtgctgggagtggtgggagcagcggcggcggcggcaatagtttcagcttcagcagcgccagcagtcttagtagcagcagcaccagtgcgggttgcgccagcagccttggcggcggcggcgcctcggagcttctccctgcaacacagcccacagccagcagcgctcccaaaagccccgagccagcccaaggcgcgcttggctgcttatagactgtactagggcggaggggatccgggccttgcgtgcagcctcccaaccatgggctgggttttgtgcttactgtatgttggcgacttggtagggcaggagacgcagcgtggagcctacctcccgacattcacgcttcgccccacgctgctccgactggctgcagcggacactgcccaaagcagaggggagtctcagtgtcctgctagccagccgaacacttctctccggaagcaggctggttcgactgtgaggtgtttgactaaactgtttctctgactcgccccagaggtcgtggctcaaaggcacttaggacgccttaaatttgtaaataaaatgtttactacggtttgtaaa

SEQ ID NO: 139495 - DNA, 695 bp, Homo sapiens
  Payload ID: 7351
  Gene Symbol: HLX
  Gene Name: H2.0-like homeobox
  ENST ID: ENST00000427693
  CDS Start-End: 241-695
acgggttctctcttgacttcgctcaataaaaatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccag

SEQ ID NO: 139496 - DNA, 587 bp, Homo sapiens
  Payload ID: 7352
  Gene Symbol: H2AFB1
  Gene Name: H2A histone family, member B1
  Uniprot ID: P0C5Y9
  ENST ID: ENST00000620016
  CDS Start-End: 79-426
actggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcccggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaa

SEQ ID NO: 139497 - DNA, 348 bp, Homo sapiens
  Payload ID: 7353
  Gene Symbol: H2AFB2
  Gene Name: H2A histone family, member B2
  Uniprot ID: P0C5Z0
  ENST ID: ENST00000354514
  CDS Start-End: 1-348
atgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactag

SEQ ID NO: 139498 - DNA, 591 bp, Homo sapiens
  Payload ID: 7354
  Gene Symbol: H2AFB3
  Gene Name: H2A histone family, member B3
  Uniprot ID: P0C5Z0
  ENST ID: ENST00000615853
  CDS Start-End: 79-426
actggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagcca

SEQ ID NO: 139499 - DNA, 785 bp, Homo sapiens
  Payload ID: 7355
  Gene Symbol: H2AFJ
  Gene Name: H2A histone family, member J
  Uniprot ID: Q9BTM1
  ENST ID: ENST00000389078
  CDS Start-End: 53-442
gacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatgagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggt

SEQ ID NO: 139500 - DNA, 644 bp, Homo sapiens
  Payload ID: 7355
  Gene Symbol: H2AFJ
  Gene Name: H2A histone family, member J
  Uniprot ID: Q9BTM1
  ENST ID: ENST00000544848
  CDS Start-End: 89-478
ggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgtt

SEQ ID NO: 139501 - DNA, 3107 bp, Homo sapiens
  Payload ID: 7355
  Gene Symbol: H2AFJ
  Gene Name: H2A histone family, member J
  ENST ID: ENST00000501744
  CDS Start-End: 1-279
gggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggagagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggttggaaattcgttcccctgacagtcatattgcataacattgcagcgcctttagtcgtgggttacatatgcttgagcttttaaagtgatgttgtcaagtttctagcttcataatgatcctgtcttcatcatatcatattcactttgagaatcggtttgactttgctttcaaacaaaacaaaaacctcttgcttttaggggttcttacccaacaaataacctgtttgaactctcttatattctcccactagcctgaagcaatgacctcattccagtaatgtctttgggagttgcattgcctaatggcacaatattgctttaataaacatgtaaggaaagataggaccaaatatgtaagtgcagggggaaacacatttcagaccaggaatccacattgaaaagttaacactagtaatcatcttctgcccttaattgacactcctatttatttcatcctcagcaaatttcatcctggctcacagaccccacaaaaaagatcccagtacagatttcacatctttggattcatctttcctgtgagtcggaattgaagtcttccccaaaaatatatgtatatattgtatgtcttcatccttggtagcggctggcccattttcccacatggactttattttgtccccagtatttattgaacagctgtctatgccaggctctgtacaaagtgataggagtagagctgtgaatgaggccaaccagatttccactctctcggagctcactttatttttattggttcctgaagacgggacaaggaacaaatacatacgttaatatgagagatcagcttctgttagtacttgtacctctctgctgtgtgtggatgaatgatggaattacttctcccatgttgccatttttgaggtgtacaaaggtcaggccgtacacacctctgttaggaggcaaattattgggcaggttcgagatgttctgctatttactctgtggttttgtcatatgtaaaagtcataacacctgttttaaggattgagattgttcatttactgtgtgccacatattagacaataaatggaaaaaagtaccatgttcaatgggggtatgggtttatccttataggttaaattataggtaaacattaataggactttttaaaaaatgcctcattgttagaactactactcacagttaccacttggggtcagtggaacaaaatgcatatatggttttgacatttgagtctaaatttcttaaagggatgaggcatctgagggattgttaccaaaatgatgaagaaataaggacaagggacatcaagacattcataagaaaaagcacctttgccttcccctgggaagattcacaggaatctgtccagctcttgttacatgatgagcaacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttacgggctgtttaaaatgcatactcctacaaaatcagctcagcccatgatccatgatgaacaaacagtagttcttgctgatgtgtgattatgaatttaaaaggccagtatttctttaagcataagaccatatggaaaaaggcctaagacaaaatctgatgggaactgaattccagtttttaatagagttataatccatagttttatttacacacaaacacacacacacacactctttcctgcagagataagcaagccgttcagtgtggctgtggcttggccaggatttgtttgatctttgtttttcctgcagggccagtcttgtctttgtgtccccgaggactggtctgtttagttgtgcctgcctggaatcaaaaggcttagtcaggccccataattggtgatgactggcatactatatgcaaacttcacaatgccccttccagtggttgaaaggtcgcataccatgctgtgtaagaactttagctctctgcaatgagacttaaattcagattcactctactccttattagttatctgatttttggaaacttaatctctttaaacctcagtttcatctctaaaatgggcataatagtttacctcatagagtttggggagaattgagtgaattaatgtgtgtgaggacactaagattcccatatagaaataggctcaatgaatagtagctgtttttatttctatgtaaagtgagtagcggtagttgatgggagctgttgaaacaggtaaacagcattctagcaatccttcgacttttgtgatagcaaaccataaaaacaattttagtggctgttttactaattaaaggacatccacaattcaatgtataacagaaaaagtaatgattaaagcttgtgaatctgaa

SEQ ID NO: 139502 - DNA, 3804 bp, Homo sapiens
  Payload ID: 7356
  Gene Symbol: H2AFV
  Gene Name: H2A histone family, member V
  Uniprot ID: Q71UI9
  ENST ID: ENST00000222690
  CDS Start-End: 107-451
gtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtgagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcgcttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcctattcctatccccagtaaaaataggcctttccacaatcttctaccagttaacttagctttttttttttttttttcctttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagaaagcaccttgaggcacagatgagaagcttggccttacctgatgccttgattttagcctggtgagaccctgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggtgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcacgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacactttttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 139503 - DNA, 752 bp, Homo sapiens
  Payload ID: 7356
  Gene Symbol: H2AFV
  Gene Name: H2A histone family, member V
  Uniprot ID: Q71UI9
  ENST ID: ENST00000308153
  CDS Start-End: 93-479
gcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaa

SEQ ID NO: 139504 - DNA, 687 bp, Homo sapiens
  Payload ID: 7356
  Gene Symbol: H2AFV
  Gene Name: H2A histone family, member V
  Uniprot ID: Q71UI9
  ENST ID: ENST00000350771
  CDS Start-End: 106-414
tccggctccggcggcggcggtcggtgctgcgagagcggcggcggcggcgcgggtcggcagcgggagggcgcgcggccgagcggaggcggagtcggcgccgagaacatgtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaa

SEQ ID NO: 139505 - DNA, 596 bp, Homo sapiens
  Payload ID: 7356
  Gene Symbol: H2AFV
  Gene Name: H2A histone family, member V
  Uniprot ID: Q71UI9
  ENST ID: ENST00000349299
  CDS Start-End: 51-323
ggcagcgggagggcgcgcggccgagcggaggcggagtcggcgccgagaacatggctggaggcaaagctggaaaggacagtgggaaggccaaggctaaggcagtatctcgctcacagagagctgggctacaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaa

SEQ ID NO: 139506 - DNA, 628 bp, Homo sapiens
  Payload ID: 7356
  Gene Symbol: H2AFV
  Gene Name: H2A histone family, member V
  Uniprot ID: Q71UI9
  ENST ID: ENST00000381124
  CDS Start-End: 110-310
attgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttt

SEQ ID NO: 139507 - DNA, 589 bp, Homo sapiens
  Payload ID: 7356
  Gene Symbol: H2AFV
  Gene Name: H2A histone family, member V
  ENST ID: ENST00000437072
  CDS Start-End: 112-342
gtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacaggtgctggagctggcaggtaatgcttctaaggatctcaaagtaaagcgtatcactccgcgtcacttgcagcttgcaatccgtggtgatgaagagttggattctcttatcaaggctaccatagctgggggtgagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcgcttttccttgcatgagtaattttctgaatgtataaaatatt

SEQ ID NO: 139508 - DNA, 1041 bp, Homo sapiens
  Payload ID: 7356
  Gene Symbol: H2AFV
  Gene Name: H2A histone family, member V
  ENST ID: ENST00000446531
  CDS Start-End: 113-481
ggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtatgtattactacttaagccttgattcttattggtctttctgactaatatatcgttcagatcaatgatatagtatatttgatcggttaactagaaagcatataaactttaatttcataaatactaaatctataacaattctaagcttttcataatgatctgaataaatatttcaccttctagccatatgtaatgctatttttattttagccagttctttgtctaaatttcatatgatacttaaagcctgatgtttaacatatttcccatacttttttaactgtgtttgaaaaatgagttggagaagttgcataacatacactggaaagggttgaaataaatacacttgaaaagtgggtcaggatcaatgaaagtgagaggtaagttggtggttcttaatcttctttggataaccctcaaagaacctcgtgaaagctgtggttacagctgggcacggtggctcacacctgtaatctcagcactttgggaggctgagaggccccggatcacccgaggtcaggagttcaagaccagcctggccaacgtggtgaaaccccatctctactaaaaatacaaaaattagctgggcgtggtggtgcacacc

SEQ ID NO: 139509 - DNA, 439 bp, Homo sapiens
  Payload ID: 7356
  Gene Symbol: H2AFV
  Gene Name: H2A histone family, member V
  ENST ID: ENST00000521529
  CDS Start-End: 70-192
ggcggcggcggcgcgggtcggcagcgggagggcgcgcggccgagcggaggcggagtcggcgccgagaacatgtttcctgtgggccgcatccacagacacttgaagactcgcaccacaagccatggaagggtgggtgccactgctgccgtgtacagtgctgcgattctggagtacctcactgcagaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtg

SEQ ID NO: 139510 - DNA, 1373 bp, Homo sapiens
  Payload ID: 7357
  Gene Symbol: H2AFX
  Gene Name: H2A histone family, member X
  Uniprot ID: P16104
  ENST ID: ENST00000375167
  CDS Start-End: 56-487
cgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgtttttttt

SEQ ID NO: 139511 - DNA, 1614 bp, Homo sapiens
  Payload ID: 7357
  Gene Symbol: H2AFX
  Gene Name: H2A histone family, member X
  Uniprot ID: P16104
  ENST ID: ENST00000530167
  CDS Start-End: 74-505
acagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcgtttgttttcattt

SEQ ID NO: 139512 - DNA, 1881 bp, Homo sapiens
  Payload ID: 7358
  Gene Symbol: H2AFY
  Gene Name: H2A histone family, member Y
  Uniprot ID: O75367
  ENST ID: ENST00000304332
  CDS Start-End: 173-1288
actgtctacattagtaattcccaacttgggtccgaaagtgaacttttgctgaagcgaagtagctaaccgcttccatgtgcaaggcaggttccagacttcggggtgaggaggattaactgaaggaccccaggggaaccggtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccg

SEQ ID NO: 139513 - DNA, 1859 bp, Homo sapiens
  Payload ID: 7358
  Gene Symbol: H2AFY
  Gene Name: H2A histone family, member Y
  Uniprot ID: O75367
  ENST ID: ENST00000312469
  CDS Start-End: 184-1293
gccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctcttccttggccagaagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgt

SEQ ID NO: 139514 - DNA, 924 bp, Homo sapiens
  Payload ID: 7358
  Gene Symbol: H2AFY
  Gene Name: H2A histone family, member Y
  ENST ID: ENST00000423969
  CDS Start-End: 202-804
agttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatcta

SEQ ID NO: 139515 - DNA, 2789 bp, Homo sapiens
  Payload ID: 7358
  Gene Symbol: H2AFY
  Gene Name: H2A histone family, member Y
  Uniprot ID: O75367
  ENST ID: ENST00000511689
  CDS Start-End: 595-1713
aacagccattgtgccttcccactgggttagtgggaaggttcctaaagatgccgtggcagcgacagtcccgtgctcagagccaggcacacagtaggcgttcactcgagacgcagagtctgggacgcgccctgaagaagctcctctccaggggcctggcccttcccaaggactgggctctgggcgtccccggggtcatgggtcagacctcgcgtccggggtgcgggctggtgcctgggcgcagagcggccggcgtcaacgggtagggcgcgggcccggggtcaaggccggggcgccgggcggcacgggcgcggaggccggacgctcggggccgcgaagggatgtgacgagcggcgcgctgtgcattgtgggaagccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttgttgtgactggtgtgttccagttattgtgcccgtgagtcacaggtcttaagtcggcttctgcagtcccaggatgtgggggcagggcagtccatccccctcaacccccaccctgctcccacaactccttggatgctccacagtgttcactgcaacctgggtgggtgtgggccatctgctggccccagtggtttgtagagagaatttttataaagtctcaccttttggttctgtgtgacccttgggccagggtgttatccccattccccgttccacagatgaaggagggagtgtatccaaagccgtgcaggtggcatgtggcaggctccagaccctgagcccagctctctcctaccattgtccccttctgacagtctgtgacttagggctgggcctggccacttgctgatgaagctgctggagcctcattccctctgccgaggctgctgggtctgtcatccctgcaggacaggatccctggca

SEQ ID NO: 139516 - DNA, 1905 bp, Homo sapiens
  Payload ID: 7358
  Gene Symbol: H2AFY
  Gene Name: H2A histone family, member Y
  ENST ID: ENST00000506671
  CDS Start-End: 211-708
actggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaactcttgtacctcaaaatgagtctgagctcccccttggagaaacgctgagaactggttgtggtttagtttcctgtttccccttgggtgttatgggtgaggcttgggagctgcctctctattaggatgcctgtgtctgtgtggcccacattctgacccttccgtctgtgcaagaagaagcagggtgaagtcagtaaggcagccagcgccgacagcacaaccgagggcacacctgccgacggcttcacagtcctctccaccaagagcctcttccttggccagaaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaa

SEQ ID NO: 139517 - DNA, 1314 bp, Homo sapiens
  Payload ID: 7358
  Gene Symbol: H2AFY
  Gene Name: H2A histone family, member Y
  Uniprot ID: O75367
  ENST ID: ENST00000510038
  CDS Start-End: 133-1251
gtctacattagtaattcccaacttgggtccgaaagtgaacttttgctgaagcgaagtagctaaccgcttccatgtgcaaggcaggttccagacttcgggtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaa

SEQ ID NO: 139518 - DNA, 1980 bp, Homo sapiens
  Payload ID: 7359
  Gene Symbol: H2AFY2
  Gene Name: H2A histone family, member Y2
  Uniprot ID: Q9P0M6
  ENST ID: ENST00000373255
  CDS Start-End: 265-1383
gagcaatcccttctccctcctcctcctccccccgctactatccgcggcccagagaactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttcttacaa

SEQ ID NO: 139519 - DNA, 908 bp, Homo sapiens
  Payload ID: 7359
  Gene Symbol: H2AFY2
  Gene Name: H2A histone family, member Y2
  ENST ID: ENST00000455786
  CDS Start-End: 181-908
gatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgt

SEQ ID NO: 139520 - DNA, 979 bp, Homo sapiens
  Payload ID: 7360
  Gene Symbol: H2AFZ
  Gene Name: H2A histone family, member Z
  Uniprot ID: P0C0S5
  ENST ID: ENST00000296417
  CDS Start-End: 219-605
ctcaaggacgcgtcccgagggcgggtggcagccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaa

SEQ ID NO: 139521 - DNA, 1882 bp, Homo sapiens
  Payload ID: 7361
  Gene Symbol: H2BFM
  Gene Name: H2B histone family, member M
  Uniprot ID: P0C1H6
  ENST ID: ENST00000355016
  CDS Start-End: 29-493
aaccgtcactctctgttcttgctatctaatggccgctgcttccgccatggctgaggcttcctctgagacaacctcggaggaaggccagagcatccaggagcccaaagaggccaactccacgaaggcccagaagcagaagaggcgagggtgccgaggctcccgcaggcgccacgccaaccgccgtggggacagcttcggggacagcttcaccccctatttcccccgggtgctgaagcaggttcaccagggcctcagcctttcccaggaggccgtgagtgtcatggattctatgatccatgacatattggaccgcatcgccaccgaggctggtcagctggcccattacaccaagcgcgtgaccatcacctcccgggacatccagatggccgtgcgactgctgctgccggggaagatgggcaagctcgccgaggcccagggcacgaatgccgccctcagaacttcattatgtgcgatatggcaacagagaaagtgaatatgctgatacaagaagcaagaaaccttccttacttccaggtgtgtgtcagtaggattacggagtgtccacggaaacagctcatgccctagtgtacagtggtacagccaatgagtgacctgcagtctatgagcaacagtcattgacccaatgtggggggagtgacccaagctgaacccacagcagccttcctgttatattcaacctggtgtttaaaggaacggcagtgtgattctttacctgatgtttttgtttgcattgcttgtaatcatgatcttttagggatatgaatccaaagctaagattagaatatgtaccttgtccctaacatcaagttatacagaacattggcaaccattagtagaagtcagataaggcttatttcctcaaaagattagcatatttatattcatgttaatattaatataggctacctttcattgtgctctcttctgggtcccaagtcttggcattttaagcatttttttctataagtgtattgctgaatttcagagcaggtgctcactttcccattgctttccttttccattgatttccagtcgcccgagtatgtggacaagagaacatactctgggactgcaacccacaggaatttattatgttgtgccttgaagctcaacatgtggccatttttgttaaatgtttcccgtaaattttgaaacatctcataaacaacccttctccttcatatgtagaaaccagtaaaggatggcactctcagtcaaaccatgaaacaaaagctggataaatgacaaaaatcaaaattttcttgagcccatcagaagtgggaaagaaccaccccagagggcccaacacatagccacatagattattccaccatttaaagaggaccccttggtcaagagggaaacagggtcagggcaagatggtagccagagcttccctgagtagtgcagatgggaagaggggaaggtcacctccagagctccacttgggatccatagagaaatgatatagaaccaagaagtccactcattgggatctgttactttctgtttttccagattattagaaaaatattacagaaatagctgaagagaaatgttatgaaaatagttgaagttgtgcttattgcacgaggagaccaagaaaaaccccacaaaatcagctgcaagtaaatccttctggatggtgccaccaaatgttcctacaagtccggaacaacccttgccaaaccaaagacccttgccagaaccctgcttcttcccagagacagagctgtgtacctgacaaaacaccacatctcactcagtgacttatttctcattatgctaattgttttgctgtaaaatgccaatgtttctgtgaattaagacatacgaataaatttctgaagttacccttgca

SEQ ID NO: 139522 - DNA, 524 bp, Homo sapiens
  Payload ID: 7361
  Gene Symbol: H2BFM
  Gene Name: H2B histone family, member M
  ENST ID: ENST00000417637
  CDS Start-End: 1-159
ctggcccattacaccaagcgcgtgaccatcacctcccgggacatccagatggccgtgcgactgctgctgccggggaagatgggcaagctcgccgaggcccagggcacgaatgccgccctcagaacttcattatgtgcgatatggcaacagagaaagtgaatatgctgatacaagaagcaagattattagaaaaatattacagaaatagctgaagagaaatgttatgaaaatagttgaagttgtgcttattgcacgaggagaccaagaaaaaccccacaaaatcagctgcaagtaaatccttctggatggtgccaccaaatgttcctacaagtccggaacaacccttgccaaaccaaagacccttgccagaaccctgcttcttcccagagacagagctgtgtacctgacaaaacaccacatctcactcagtgacttatttctcattatgctaattgttttgctgtaaaatgccaatgtttctgtgaattaagacatacgaataaatttctgaagttacccttgca

SEQ ID NO: 139523 - DNA, 465 bp, Homo sapiens
  Payload ID: 7361
  Gene Symbol: H2BFM
  Gene Name: H2B histone family, member M
  Uniprot ID: P0C1H6
  ENST ID: ENST00000598335
  CDS Start-End: 1-465
atggccgctgcttccgccatggctgaggcttcctctgagacaacctcggaggaaggccagagcatccaggagcccaaagaggccaactccacgaaggcccagaagcagaagaggcgagggtgccgaggctcccgcaggcgccacgccaaccgccgtggggacagcttcggggacagcttcaccccctatttcccccgggtgctgaagcaggttcaccagggcctcagcctttcccaggaggccgtgagtgtcatggattctatgatccatgacatattggaccgcatcgccaccgaggctggtcagctggcccattacaccaagcgcgtgaccatcacctcccgggacatccagatggccgtgcgactgctgctgccggggaagatgggcaagctcgccgaggcccagggcacgaatgccgccctcagaacttcattatgtgcgatatggcaacagagaaagtga

SEQ ID NO: 139524 - DNA, 460 bp, Homo sapiens
  Payload ID: 7362
  Gene Symbol: H2BFS
  Gene Name: H2B histone family, member S (pseudogene)
  Uniprot ID: P57053
  ENST ID: ENST00000599962
  CDS Start-End: 51-431
cccgttttcacgatctgctgctcgtctcaggctcgtagttcgccttcaacatgccggagccagcgaagtccgctcccgcgcccaagaagggctcgaagaaagccgtgactaaggcgcagaagaaggacggcaggaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcaggtgaggcttcccgcctgccgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaattgatgcctgcagctcctg

SEQ ID NO: 139525 - DNA, 894 bp, Homo sapiens
  Payload ID: 7363
  Gene Symbol: H2BFWT
  Gene Name: H2B histone family, member W, testis-specific
  Uniprot ID: Q7Z2G1
  ENST ID: ENST00000217926
  CDS Start-End: 28-555
cgtgaagctggcccgagacgtggagccatgctgcgtaccgaagtgccccggcttccccggtccacaaccgccattgtctggtcgtgccatctaatggccactgcctccgccatggctggaccttcctctgagacgacctctgaggaacagctgatcacccaggagcccaaagaggccaactccactacgtcccagaagcagagcaagcagaggaagcgagggcgccatgggccccgcaggtgccactccaactgccgcggggacagcttcgccacctatttccgccgggtgctgaagcaggttcaccagggcctcagcctttcccgggaggccgtgagtgtcatggattctttggttcatgacatattggaccgcatcgccaccgaggctggtcacctggcccgctccaccaagcgccagaccatcactgcctgggagacccggatggctgtgcgcctgctgctgccggggcagatgggcaagctcgccgagtccgaaggcacgaaggctgtcctcagaacttcactgtatgccatacagcaacagagaaagtgaatacgctgatacaagaagcaagaatattagaaaaatgtcatgaaaatagttgaagagaaatgctcactgcacaaggagaccaagaaaaaccccccacgaaatcagccacaactaaatcgctctggacggtgccgccaggtgaccctacatgtccggagcaacactttgaaaaccaaagacgcttggcagaaccctgttcctttccagagacagagctgtgtaccttgtctaaaacaccgcatctcactcagtgacttatttctcattatgctaattgttttcgctttaaagcgccagtctttctgtcaaatgggacatacaaataaatttctaaaatta

SEQ ID NO: 139526 - DNA, 528 bp, Homo sapiens
  Payload ID: 7363
  Gene Symbol: H2BFWT
  Gene Name: H2B histone family, member W, testis-specific
  Uniprot ID: Q7Z2G1
  ENST ID: ENST00000611083
  CDS Start-End: 1-528
atgctgcgtaccgaagtgccccggcttccccggtccacaaccgccattgtctggtcgtgccatctaatggccactgcctccgccatggctggaccttcctctgagacgacctctgaggaacagctgatcacccaggagcccaaagaggccaactccactacgtcccagaagcagagcaagcagaggaagcgagggcgccatgggccccgcaggtgccactccaactgccgcggggacagcttcgccacctatttccgccgggtgctgaagcaggttcaccagggcctcagcctttcccgggaggccgtgagtgtcatggattctttggttcatgacatattggaccgcatcgccaccgaggctggtcacctggcccgctccaccaagcgccagaccatcactgcctgggagacccggatggctgtgcgcctgctgctgccggggcagatgggcaagctcgccgagtccgaaggcacgaaggctgtcctcagaacttcactgtatgccatacagcaacagagaaagtga

SEQ ID NO: 139527 - DNA, 1308 bp, Homo sapiens
  Payload ID: 7364
  Gene Symbol: H3F3A
  Gene Name: H3 histone, family 3A
  Uniprot ID: P84243
  ENST ID: ENST00000366813
  CDS Start-End: 376-786
ttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcaccctttcaaattatataacaatacgaacattattttttatactgatcataatttccagatttggggagggggtgatcgtggcaggaaaagttgtatgtttggtagttgcatatggtgatttttgatttttcaatgctggtaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactat

SEQ ID NO: 139528 - DNA, 1863 bp, Homo sapiens
  Payload ID: 7364
  Gene Symbol: H3F3A
  Gene Name: H3 histone, family 3A
  ENST ID: ENST00000366814
  CDS Start-End: 122-493
atctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggtaaaatggtgggtgggaagactcagagtttgtattcctgttgtgtaccaagaacagttccaaattgttgcatgtgcttatatcatttaatcacaagcctgtcaggtagttgatattgttacttcactgttgagacttcagaaaggttaaattgctcaaggtcatacacgtagaaaatggcaaaaccataatttgaacctatttgactccaaggcttagtgcacattccattataccatttaaaattttgaaacattgcactaaaaacaatatttaaagaaaatcctctggtttggtttatggatgctgcaggacattaagaagaacttgagactagaggtctatatttgtagtaacaatttcaaacaacagtgcctagaataaaagaaatgtctcttcaggtcctgaagaaacatataggtagagagagcttaatacctaggatgggaataggcagtattaaaaaattatgcattaagacgtaaaaggagcagtgagtggaggataggattggattggcaagattgggggaacggtgcttaaaggtgatactggacgtgtaaaggggccaggatttgccttgtggtttcctaaaggggattagggattgccacttacatgtggagcatattgaatttaatcttaatctctagcatgtcaggacttagagaaatactgttctagagatatttatgtatttgagatatttgtggtttaagttaagaccaaaacttgaaattcctacaagatacttgataaaggtatgtagacgtcattaacatcagtcacttaagtaacctattttatattgtgtggttggattctttagttgcaagtatcccagaatacagtaaagctaccacctccatcagaagcatgcagttgggggtcgttaaaaatgctgattgttaggcaccattgcagacctgaatcattctgggggtggggagggggcatccagaatctaagtacattccattggaggattttcaaggctgctgttgctgtgctgggcttttgctttatgtatgagaaagataggataggtggattccaccctgaagtgtaattggtcgagctgtttctatggttaatctaaacttcatttgattggtgaattccaggagtaggcatccattaaattctcagtgagttgctgaaatttcaactactaaaatcttccatgtttttacttaaaactttattttctgttttaatagccgattatcttcagttcttatttattactaaatacagaaatgttactaagattcgtaagcattggtacaaagctgctaatattttctagttagaactgtgcttaaagaacaatactgtacttgaaaagtgtagcgtttttagcttaaatgtcaataatgtagccttttaaattgaatttactaaacaatctgggtaaaagactcatctttctaaaattattcacatgtaaacttccattg

SEQ ID NO: 139529 - DNA, 1088 bp, Homo sapiens
  Payload ID: 7364
  Gene Symbol: H3F3A
  Gene Name: H3 histone, family 3A
  Uniprot ID: P84243
  ENST ID: ENST00000366815
  CDS Start-End: 158-568
ggcggcgtgtgttgggggatagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaact

SEQ ID NO: 139530 - DNA, 799 bp, Homo sapiens
  Payload ID: 7364
  Gene Symbol: H3F3A
  Gene Name: H3 histone, family 3A
  Uniprot ID: P84243
  ENST ID: ENST00000366816
  CDS Start-End: 345-755
cgcgacacagccatcttgcgtcgggggcccgggcccgggaggagagcgagccccgtcccctgatcccggaggccaacaccggcgaggggctgccctgcacgcaggcggccggcccaggagtcttagcggatcaagttgtctacggcggactcgggccggtcccgcaggacccggccgcacttggccgagcgcgcaggcgggaaggaggccgtcggtccgcccctcccgctgccgcagcggccagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaa

SEQ ID NO: 139531 - DNA, 2705 bp, Homo sapiens
  Payload ID: 7365
  Gene Symbol: H3F3B
  Gene Name: H3 histone, family 3B (H3.3B)
  Uniprot ID: P84243
  ENST ID: ENST00000254810
  CDS Start-End: 134-544
gagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaactaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtacgtggatgtcagtgagacagcatgagagccagcagtcatcaaagcgttccacgtttgaagttagcaactgcttaaagttataccccattaaaattgctttctcaaaagtttgggttagtttcaaatgtgatattttggagggaaggtaaagtaggtatctttcaggtcgtgataatgagctcctatgaaaggatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagttaa

SEQ ID NO: 139532 - DNA, 468 bp, Homo sapiens
  Payload ID: 7365
  Gene Symbol: H3F3B
  Gene Name: H3 histone, family 3B (H3.3B)
  ENST ID: ENST00000586270
  CDS Start-End: 73-468
gcgcgccgcggccgttgggagccgagcggcgggggctgctcgggccgctggcgtcgggtcgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacgg

SEQ ID NO: 139533 - DNA, 576 bp, Homo sapiens
  Payload ID: 7365
  Gene Symbol: H3F3B
  Gene Name: H3 histone, family 3B (H3.3B)
  Uniprot ID: P84243
  ENST ID: ENST00000589599
  CDS Start-End: 145-555
ggagcgcagagcggtttggtcgttcgttgggcggtgctggtttttcgctcgtcgactgcggctcttcctcgggcagcggaagcggcgcggcggtcggagaagtggcctaaaacttcggcgttgggtaggcgttcgtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcg

SEQ ID NO: 139534 - DNA, 551 bp, Homo sapiens
  Payload ID: 7365
  Gene Symbol: H3F3B
  Gene Name: H3 histone, family 3B (H3.3B)
  Uniprot ID: P84243
  ENST ID: ENST00000586607
  CDS Start-End: 122-532
aagcaagtgtggccctcgtggacaacctacgagccttagggacacaaaaggcttcctgcgcaaactgcacggaatctcctgacaggacttcacgttaatcatcattcataggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatgg

SEQ ID NO: 139535 - DNA, 783 bp, Homo sapiens
  Payload ID: 7365
  Gene Symbol: H3F3B
  Gene Name: H3 histone, family 3B (H3.3B)
  ENST ID: ENST00000591890
  CDS Start-End: 114-392
gttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttg

SEQ ID NO: 139536 - DNA, 795 bp, Homo sapiens
  Payload ID: 7365
  Gene Symbol: H3F3B
  Gene Name: H3 histone, family 3B (H3.3B)
  ENST ID: ENST00000592643
  CDS Start-End: 113-454
ttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttga

SEQ ID NO: 139537 - DNA, 586 bp, Homo sapiens
  Payload ID: 7365
  Gene Symbol: H3F3B
  Gene Name: H3 histone, family 3B (H3.3B)
  ENST ID: ENST00000587171
  CDS Start-End: 133-586
agcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggtaagacaaaggcctggagccgggggagggctgggcggtttccgctccccgagtgggattaatagtgcggctctcgtcctcaacaggaggctagcgaagcgtacctggtgggtctgttcgaagataccaacctgtgtgccatccacgctaagagagtcaccatcatgcccaa

SEQ ID NO: 139538 - DNA, 551 bp, Homo sapiens
  Payload ID: 7365
  Gene Symbol: H3F3B
  Gene Name: H3 histone, family 3B (H3.3B)
  Uniprot ID: P84243
  ENST ID: ENST00000587560
  CDS Start-End: 113-523
cgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgta

SEQ ID NO: 139539 - DNA, 1057 bp, Homo sapiens
  Payload ID: 7366
  Gene Symbol: H3F3C
  Gene Name: H3 histone, family 3C
  Uniprot ID: Q6NXT2
  ENST ID: ENST00000340398
  CDS Start-End: 76-483
ggctcttcctcgggcagcggaagcagcgcggaggtcggagaagtggcctaaaacttcggcgttgggtgaaagaaaatggcccgaaccaagcagactgctcgtaaatccaccggtgggaaagccccccgcaaacagctggccacgaaagctgccaggaaaagcaccccctctacctgcggggtgaagcctcatcgctacaggcctgggaccgtggcgcttcgagagattcgtcgttatcagaagtcgaccgagctgctcatccggaagctgcccttccagaggttggtgagggagatcgcgcaggatttcaacactgacctgaggtttcagagcgcagccgtcggtgcgctgcaggaggctagcgaagcgtacctggtgggtctgttggaagatactaacctgtgtgccatccacgctaagagagtcaccatcatgcccaaagacatccagttggctcgccggatacggggagagagagcttaagtgaaggcagtttttatggcattttgtagtaaattctgtaaaatactttggtttaattggtgactttttttgtaagaaattgtttatatgttgcatttgtacttaagtcattccatctttcactcaggatgaatgcgaaaagtgactgtttacagacctcagtgatgtcagcactgttgctcaggagtgacaagttgttaatatgcaaaacggatgcgtgatatttcttgcttctcatgatgcatgtttctgtatgttaatgacttgttgggtagctattaaggtactagaattgataaatgtgtacaacagggtccttttgcaataaaactggttatgacttgatccaagtgtttaacaattggggctgttaagtctgaccatacatcactgtgatagaatgtaggctttttcaagggtgaagatacaaaccttaaccacagtgtaacttatagtttcctttaaaaaaaaaaaattaaacctggcagctatagaatacaatatgtgcatttataatagctattttatatattgtagtgtcaacattttcaaattaaatgttttacattcacaa

SEQ ID NO: 139540 - DNA, 1895 bp, Homo sapiens
  Payload ID: 7367
  Gene Symbol: HMX1
  Gene Name: H6 family homeobox 1
  Uniprot ID: Q9NP08
  ENST ID: ENST00000400677
  CDS Start-End: 204-1250
ccgatcagctgtcggcgcgcactcgctcccggcccggcccagcccagcccggcgcggaggccgccgcctgccctgcggggcccgacgccagcggtccgggtagcagctccagggccggcccgcgcgtgcgcccgggagccgcgcgccaccatccccagcggggaccgaggagcccggccgagcccgagaagcccgcggccgcgatgcctgacgagctgacggagcccgggcgcgccacgccggcccgcgcctcctccttcctcatcgagaacctgctggcggccgaggccaagggcgcagggcgcgcgacccagggcgacggcagccgggaggacgaggaggaggacgacgacgaccccgaagacgaggacgccgagcaggcgcggcggcgacggctacagcggcggcgacagttgctcgcgggcaccgggcccggcggggaggcgcgggcccgtgcgctgctcgggccgggcgcgctgggcctcggtcctcggccgccccccggtcccgggccgcccttcgctctgggctgcggaggcgcagcgcgctggtacccacgggcgcacggtggctatggaggcggcctcagtcctgacaccagcgaccgggactcaccggagacgggcgaggagatgggccgtgcggagggcgcctggccgcgaggccccgggccgggagcggtgcagcgggaggcagcggagctggcggcgcgtggcccggcggccggcacggaggaggcgtcggagctggccgaggtccctgcggcggctggggagacacgcggcggcgttggcgtgggcggcggccgaaagaagaagacgcgcacagtcttctcccgcagccaggtcttccagctggaatccaccttcgacctgaagcgctacctgagcagcgccgagcgcgccggcctggccgcctccctgcagctcaccgagacgcaggttaagatctggttccagaaccgccgcaacaagtggaagcggcagctggcagccgagctggaggcggccagcctgtccccgccgggagcgcagcgcctggtccgcgtgccggtgctctaccacgaaagccccccggccgcagccgccgctgggcccccggccaccctgcccttcccgctggcgcccgccgcgcccgcgccgcccccaccgctgctcggcttctccggggccctcgcctacccgctggccgccttcccggccgccgcctccgtgccctttctgcgggcgcagatgcctggcctggtgtgagccccgcctgccgggccctctccccacgaccctgtggacctgtgtggacgcgcgattcagcggcaggcgcagggctcagggggcgttagggaagggatggtcgctcctgcggcctcctagatacctcgggagcgcaggccgcggccgggcgggcctcagcttctgtggggagcgcctctagaatgtaatgggacgccccacccatttgccaggctggatccccactcgaacagggggccatgcagagactctgggctgcgcagcccccggcgccacggccaccccccggcctcagcgaggagcggtcggccatggccacccggggcagctgccctcaggccaagcccagcgcaacaaaggaaaactacgaaccggctgtccaaggctgagcggtgactgtccccacagactgcccccaacactaaacgtccctttcctgggacccagacagcaggccggcccggagggctgtgctacccctctcgcgggtgctggtggagaaaggaccctggacctgtgggtcccatcgtccgttccaggagcaggcaggctggggctctctgcagacgtcgcagcctccgggttgttgtttttttaaatgaatctacttatttgcgtatggaataaaaagggacattttctgga

SEQ ID NO: 139541 - DNA, 651 bp, Homo sapiens
  Payload ID: 7367
  Gene Symbol: HMX1
  Gene Name: H6 family homeobox 1
  ENST ID: ENST00000506970
  CDS Start-End: 9-581
cggccgcgatgcctgacgagctgacggagcccgggcgcgccacgccggcccgcgcctcctccttcctcatcgagaacctgctggcggccgaggccaagggcgcagggcgcgcgacccagggcgacggcagccgggaggacgaggaggaggacgacgacgaccccgaagacgaggacgccgagcaggcgcggcggcgacggctacagcggcggcgacagttgctcgcgggcaccgggcccggcggggaggcgcgggcccgtgcgctgctcgggccgggcgcgctgggcctcggtcctcggccgccccccggtcccgggccgcccttcgctctgggctgcggaggcgcagcgcgctggtacccacgggcgcacggtggctatggaggcggcctcagtcctgacagcacacagaagattacacctcagcctgtgcagtgtggagaggggcaggtgaccagagctgataaatacaaagtgaacagaagtgacagtgggagcctctggatggcggaggaggccgcagggactggatggtgcagccacaacacggtggagcctttgtcagcctggacccccgagtgaccgcgtggagcagtgttcccacagggggcactcagtgtgagcaagaaataaaccttagtgtgtgcaccca

SEQ ID NO: 139542 - DNA, 1879 bp, Homo sapiens
  Payload ID: 7367
  Gene Symbol: HMX1
  Gene Name: H6 family homeobox 1
  ENST ID: ENST00000617742
  CDS Start-End: 204-1325
ccgatcagctgtcggcgcgcactcgctcccggcccggcccagcccagcccggcgcggaggccgccgcctgccctgcggggcccgacgccagcggtccgggtagcagctccagggccggcccgcgcgtgcgcccgggagccgcgcgccaccatccccagcggggaccgaggagcccggccgagcccgagaagcccgcggccgcgatgcctgacgagctgacggagcccgggcgcgccacgccggcccgcgcctcctccttcctcatcgagaacctgctggcggccgaggccaagggcgcagggcgcgacccagggcgacggcagccgggaggacgaggaggaggacgacgacgaccccgaagacgaggacgccgagcaggccggcggcgacggctacagcggcggcgacagttgctcgcgggcaccgggcccggcggggaggcgcgggccgtggctgctcgggccggcgcgctgggcctcggtcctcggccgccccccggtcccgggccgcccttcgctctgggctgcggaggcgcagcgcgctggtacccacgggcgcacggtggctatggaggcggcctcagtcctgacaccagcgaccgggactcaccggagacgggcgaggagatgggccgtgcggagggcgcctggccgcgaggcccgggccggagcggtgcagcgggaggcagcggagctggcggcgcgtggcccggcggccggcacggaggaggctcggagctggccgaggtccctgcggcggctggggagacacgcggcggcgttggcgtgggcggcggccgaaagaagaagacgcgcacagtcttctcccgcagccaggtcttccagctggaatccaccttcgacctgaagcgctacctgagcagcgccgagcgcgccggcctggccgcctccctgcagctcaccgagacgcaggttaagatctggttccagaaccgccgcaacaagtggaagcggcagctggcagccgagctggaggcggccagcctgtccccgccgggagcgcaggcctggtccgcgtgccggtgctctaccacgaaagccccccggccgcagccgccgctgggcccccggccaccctgcccttcccgctggcccgcccgcccgcgccgcccccaccgctgctcggcttctccggggccctcgcctacccgctggccgccttcccggccgccgcctccgtgccctttctgcgggcgcagatgcctggcctggtgtgagccccgcctgccgggccctctccccacgaccctgtggacctgtgtggacgcgcgatcagcggcaggcgcagggctcagggggcgttagggaagggatggtcgctcctgcggcctcctagatacctcgggagcgcaggccgcggccgggcgggcctcagcttctgtggggagcgcctctagaatgtaatgggacgccccacccatttgccaggctggatccccactcgaacagggggccatgcagagactctgggctgcgcagcccccggcgccacggccaccccccggcctcagcgaggagcggtcggccatggccacccggggcagctgccctcaggccaagcccagcgcaacaaaggaaaactacgaaccggctgtccaaggctgagcggtgactgtccccacagactgcccccaacactaaacgtccctttcctgggacccagacagcaggccggcccggagggctgtgctacccctctcgcgggtgctggtggagaaaggaccctggacctgtgggtcccatcgtccgttccaggagcaggcaggctggggctctctgcagacgtcgcagcctccgggttgttgtttttttaaatgaatctacttatttgcgtatggaataaaaagggacattttctg

SEQ ID NO: 139543 - DNA, 1628 bp, Homo sapiens
  Payload ID: 7368
  Gene Symbol: HMX2
  Gene Name: H6 family homeobox 2
  Uniprot ID: A2RU54
  ENST ID: ENST00000339992
  CDS Start-End: 258-1079
cgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgcccgcagagccgggcgcgtactgtactgtaagcagggctccggagcaaggcggcgtgtttccagaaatatgaagaaatacaccatgtgtattcattagctcttatttatggtctctgccctactttttgttttgattgtttcgggtatttattggcattccctaagtcagagagcctgcttcctacctagaccgaaccagtacgctttgaaaaccattcggagtgagatgttctcgggtggtggtgggaaagggagttttggccagacaggctgtggttggtagggaaaaaaatcaggaaaacacctacaaaaccaggtacactcctcccccatatatacacctgtatatatgtacatgcatacacgctcggccaagccaggccctcagaggctttggacaattactaaattgcttcttttcgtttccctcatcccgaggatggtagggacgaaaaggggagagttcagatctgtaaatatttttaaaaagaaaaaaaaataaaacattttaaacatc

SEQ ID NO: 139544 - DNA, 1173 bp, Homo sapiens
  Payload ID: 7369
  Gene Symbol: HMX3
  Gene Name: H6 family homeobox 3
  Uniprot ID: A6NHT5
  ENST ID: ENST00000357878
  CDS Start-End: 90-1163
tatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggccgccccctaagcctcagccgcccccacggacgctcttcgcgccagcctcggctgccgccgccgccgccgctgccgctgccgcggcggccaagggggccctggagggcgccgcgggcttcgcgctctcgcaggtgggcgacctggctttccctcgctttgagatcccggcgcagaggtttgccctgcccgcgcactacctggagcgctccccagcctggtggtacccctacaccctgacccccgccggcggccacctcccgcgacctgaagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagag

SEQ ID NO: 139545 - DNA, 5351 bp, Homo sapiens
  Payload ID: 7370
  Gene Symbol: HR
  Gene Name: hair growth associated
  Uniprot ID: O43593
  ENST ID: ENST00000312841
  CDS Start-End: 666-4070
ggtgctggaggaggaaaccggcggagcagcttccccactctcagttgcgcttctggcgatggcgatcagaggtcctgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaa

SEQ ID NO: 139546 - DNA, 6336 bp, Homo sapiens
  Payload ID: 7370
  Gene Symbol: HR
  Gene Name: hair growth associated
  Uniprot ID: O43593
  ENST ID: ENST00000381418
  CDS Start-End: 1482-5051
tctcccgggagccactcccatgggcgcctctccagcccctggcctggaagcaccaggaaccctggggatggggcagaccctcacagcccggggtctggagccggtgtcggagctcatctgggcccatgacctctccagacatttggcaaaatcaaggcccttagaccagggacagacccaagcccaggccctcccagaggtcctaggacgcaaccctttgtgcccttgggctctggaagaggtttgggaagggtttggggtggaagatggcaaagagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctctcggcaggcgcccgggtgccgcgggggggagggggaacaaagggctcattctccccgtgcgcagccggtggcatcgccggggcgttggcggaagcccccggggcccgggagggggcaggcccaggcgcggccgccgaatcacgggctcctgtttcccgcagggtgctggaggaggaaaccggcggagcagcttccccactctcagttgcgcttctggcgatggcgatcagaggtcctgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaatata

SEQ ID NO: 139547 - DNA, 772 bp, Homo sapiens
  Payload ID: 7370
  Gene Symbol: HR
  Gene Name: hair growth associated
  ENST ID: ENST00000517699
  CDS Start-End: 1-163
cacgcaggaggccgggcacgctgcctgttccctgatgctgacccagtttgtctccagccaggaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttggggga

SEQ ID NO: 139548 - DNA, 2212 bp, Homo sapiens
  Payload ID: 7371
  Gene Symbol: HDHD2
  Gene Name: haloacid dehalogenase-like hydrolase domain containing 2
  Uniprot ID: Q9H0R4
  ENST ID: ENST00000300605
  CDS Start-End: 154-933
ttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcagtgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtgagcactgt

SEQ ID NO: 139549 - DNA, 559 bp, Homo sapiens
  Payload ID: 7371
  Gene Symbol: HDHD2
  Gene Name: haloacid dehalogenase-like hydrolase domain containing 2
  ENST ID: ENST00000592591
  CDS Start-End: 194-559
cttccggcgtccgtcgggcagcagcggggctgtctatcccggctgaggacccgcggccagtgcgggtggctggctttgccattagcgggggcctttcctgaggacggcgtacggagtgtggacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattc

SEQ ID NO: 139550 - DNA, 576 bp, Homo sapiens
  Payload ID: 7371
  Gene Symbol: HDHD2
  Gene Name: haloacid dehalogenase-like hydrolase domain containing 2
  ENST ID: ENST00000591268
  CDS Start-End: 145-309
agtggccccgcgcgtgcgcatagctgggcgcgaggcgcgctgtgggtctctgcggggcggatcgtgaagctagtgtgtcagtcattcctcgaagcgtgctcttgggctgtattttggagctagcgtccctcctgggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccg

SEQ ID NO: 139551 - DNA, 2224 bp, Homo sapiens
  Payload ID: 7371
  Gene Symbol: HDHD2
  Gene Name: haloacid dehalogenase-like hydrolase domain containing 2
  ENST ID: ENST00000588183
  CDS Start-End: 134-298
aacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcagtgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtgagc

SEQ ID NO: 139552 - DNA, 569 bp, Homo sapiens
  Payload ID: 7371
  Gene Symbol: HDHD2
  Gene Name: haloacid dehalogenase-like hydrolase domain containing 2
  ENST ID: ENST00000591480
  CDS Start-End: 132-569
cttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggctta

SEQ ID NO: 139553 - DNA, 566 bp, Homo sapiens
  Payload ID: 7371
  Gene Symbol: HDHD2
  Gene Name: haloacid dehalogenase-like hydrolase domain containing 2
  ENST ID: ENST00000587388
  CDS Start-End: 172-566
agcggggctgtctatcccggctgaggacccgcggccagtgcgggtggctggctttgccattagcgggggcctttcctgaggacggcgtacggagtgtggacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccg

SEQ ID NO: 139554 - DNA, 568 bp, Homo sapiens
  Payload ID: 7371
  Gene Symbol: HDHD2
  Gene Name: haloacid dehalogenase-like hydrolase domain containing 2
  ENST ID: ENST00000586546
  CDS Start-End: 189-353
ggcgtccgtcgggcagcagcggggctgtctatcccggctgaggacccgcggccagtgcgggtggctggctttgccattagcgggggcctttcctgaggacggcgtacggagtgtggacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggttactcctggatggagcacctctgatagcaat

SEQ ID NO: 139555 - DNA, 546 bp, Homo sapiens
  Payload ID: 7371
  Gene Symbol: HDHD2
  Gene Name: haloacid dehalogenase-like hydrolase domain containing 2
  ENST ID: ENST00000588940
  CDS Start-End: 151-546
ctttgcagtggccccgcgcgtgcgcatagctgggcgcgaggcgcgctgtgggtctctgcggggcggatcgtgaagctagtgtgtcagtcattcctcgaagcgtgctcttgggctgtattttggagctagcgtccctcctgggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccgg

SEQ ID NO: 139556 - DNA, 569 bp, Homo sapiens
  Payload ID: 7371
  Gene Symbol: HDHD2
  Gene Name: haloacid dehalogenase-like hydrolase domain containing 2
  ENST ID: ENST00000590481
  CDS Start-End: 173-569
agcagcggggctgtctatcccggctgaggacccgcggccagtgcgggtggctggctttgccattagcgggggcctttcctgaggacggcgtacggagtgtggccctccacatacataacccaacctttctctgagcgggacacaattcacaattctttatagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggt

SEQ ID NO: 139557 - DNA, 809 bp, Homo sapiens
  Payload ID: 7371
  Gene Symbol: HDHD2
  Gene Name: haloacid dehalogenase-like hydrolase domain containing 2
  ENST ID: ENST00000590815
  CDS Start-End: 197-809
cggctgaggacccgcggccagtgcgggtggctggctttgccattagcgggggcctttcctgaggacggcgtacggagtgtggaacagaattctggagtaaagaagcaggttcccttttcgctagacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatg

SEQ ID NO: 139558 - DNA, 1834 bp, Homo sapiens
  Payload ID: 7372
  Gene Symbol: HDHD3
  Gene Name: haloacid dehalogenase-like hydrolase domain containing 3
  Uniprot ID: Q9BSH5
  ENST ID: ENST00000238379
  CDS Start-End: 899-1654
ctgaggcaggagaatcgcttgaacctgggaggcggaggttgcagtgagccgagatcgcgccattgcacttcagcctgggcaacaagaacgaaactccgcctcaaaaaaaaaaaaaaaaaaaaaaaaaagccgtgggtcaggagccagagccctctgctctagtcttagctgtgccaatgtgactccctgtgtgatttgggggtaaattactgcccctcactgggtctctgtctacccacctgcaaaatgagaggatctttggatgagtctccttaattcatttcctggacaaacttcctccaaggctcccccagatttaccagtgacgcccttccctaagtatcaacttagccgtactttgaactctggcccctcaggtttcaaggggacggccttgtctgggatcagctctgtctggggaaagaagctgcaccagcctctggatagcaggctgagtcacttgtttcttgtgccttgagtcagttctctcatcagctctcctcctaggccagtgttattacctccagtaaagatggaaaagttggggttcagagagggctagagacagacagcctgctgtgtcctgtcttttctcctgtgctgtacaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggggggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaacca

SEQ ID NO: 139559 - DNA, 1497 bp, Homo sapiens
  Payload ID: 7372
  Gene Symbol: HDHD3
  Gene Name: haloacid dehalogenase-like hydrolase domain containing 3
  Uniprot ID: Q9BSH5
  ENST ID: ENST00000374180
  CDS Start-End: 562-1317
ccggcgcttgcgcacctccgcccgagctcgcgggccttgcggctgcgttttcaatctgcttccttgtgagtcaggtgggtcctgggcccaggaaccggcccggagccgtggacgccctacagctgagaaggggacccaaggggtcggccgcggccaaggcccctaggaccgccgccccagctcacgctgccgacggcagctatagacattctgcgtcaggtccgggctcctggacttcgcctttcccgagccctggaggtggggagaaaaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggggggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaacca

SEQ ID NO: 139560 - DNA, 960 bp, Homo sapiens
  Payload ID: 7373
  Gene Symbol: HP
  Gene Name: haptoglobin
  ENST ID: ENST00000228226
  CDS Start-End: 115-960
agatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaa

SEQ ID NO: 139561 - DNA, 1443 bp, Homo sapiens
  Payload ID: 7373
  Gene Symbol: HP
  Gene Name: haptoglobin
  Uniprot ID: P00738
  ENST ID: ENST00000355906
  CDS Start-End: 59-1279
ataaaaagaccagcagatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 139562 - DNA, 1482 bp, Homo sapiens
  Payload ID: 7373
  Gene Symbol: HP
  Gene Name: haptoglobin
  ENST ID: ENST00000357763
  CDS Start-End: 28-1356
gctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggggaggcgatgccatgcagcctacctcatgtaaatctcagagtcacatttacatctccagcagatgtgggaaaagaaggaatgctgatgatgatgtcaccctcacctagagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgc

SEQ ID NO: 139563 - DNA, 1252 bp, Homo sapiens
  Payload ID: 7373
  Gene Symbol: HP
  Gene Name: haptoglobin
  Uniprot ID: P00738
  ENST ID: ENST00000398131
  CDS Start-End: 45-1088
agatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 139564 - DNA, 685 bp, Homo sapiens
  Payload ID: 7373
  Gene Symbol: HP
  Gene Name: haptoglobin
  ENST ID: ENST00000562526
  CDS Start-End: 28-306
gctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 139565 - DNA, 1187 bp, Homo sapiens
  Payload ID: 7373
  Gene Symbol: HP
  Gene Name: haptoglobin
  ENST ID: ENST00000565574
  CDS Start-End: 25-1068
cttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgcca

SEQ ID NO: 139566 - DNA, 695 bp, Homo sapiens
  Payload ID: 7373
  Gene Symbol: HP
  Gene Name: haptoglobin
  ENST ID: ENST00000564499
  CDS Start-End: 28-695
gctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaa

SEQ ID NO: 139567 - DNA, 1270 bp, Homo sapiens
  Payload ID: 7373
  Gene Symbol: HP
  Gene Name: haptoglobin
  Uniprot ID: P00738
  ENST ID: ENST00000570083
  CDS Start-End: 62-1105
agcataaaaagaccagcagatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 139568 - DNA, 1067 bp, Homo sapiens
  Payload ID: 7373
  Gene Symbol: HP
  Gene Name: haptoglobin
  ENST ID: ENST00000576168
  CDS Start-End: 1-448
tgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcaggtgggtgctgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattagggcctgaagggcactggctgaatccattgtctacatcgcccacagattaggagagcctgtgcatacagagagcctgctagagagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaacaagaggcaaaggcccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgg

SEQ ID NO: 139569 - DNA, 280 bp, Homo sapiens
  Payload ID: 7373
  Gene Symbol: HP
  Gene Name: haptoglobin
  ENST ID: ENST00000568417
  CDS Start-End: 16-280
gcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcag

SEQ ID NO: 139570 - DNA, 1232 bp, Homo sapiens
  Payload ID: 7373
  Gene Symbol: HP
  Gene Name: haptoglobin
  ENST ID: ENST00000567612
  CDS Start-End: 1-1096
tgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagt

SEQ ID NO: 139571 - DNA, 568 bp, Homo sapiens
  Payload ID: 7373
  Gene Symbol: HP
  Gene Name: haptoglobin
  ENST ID: ENST00000569639
  CDS Start-End: 31-306
actgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcaggtgggtgctgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattagggcctgaagggcactggctgaatccattgtctacatcgcccacagattaggagagcctgtgcatacagagagcctgcta

SEQ ID NO: 139572 - DNA, 1251 bp, Homo sapiens
  Payload ID: 7373
  Gene Symbol: HP
  Gene Name: haptoglobin
  ENST ID: ENST00000567185
  CDS Start-End: 1-1213
tgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatgtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagat

SEQ ID NO: 139573 - DNA, 1107 bp, Homo sapiens
  Payload ID: 7373
  Gene Symbol: HP
  Gene Name: haptoglobin
  ENST ID: ENST00000613898
  CDS Start-End: 98-943
gctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 139574 - DNA, 1110 bp, Homo sapiens
  Payload ID: 7374
  Gene Symbol: HPR
  Gene Name: haptoglobin-related protein
  ENST ID: ENST00000356967
  CDS Start-End: 101-946
gctcttccagaggcaagaccaaccaagatgagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 139575 - DNA, 1244 bp, Homo sapiens
  Payload ID: 7374
  Gene Symbol: HPR
  Gene Name: haptoglobin-related protein
  Uniprot ID: P00739
  ENST ID: ENST00000540303
  CDS Start-End: 33-1079
gcactgctcttccagaggcaagaccaaccaagatgagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 139576 - DNA, 634 bp, Homo sapiens
  Payload ID: 7374
  Gene Symbol: HPR
  Gene Name: haptoglobin-related protein
  ENST ID: ENST00000561690
  CDS Start-End: 28-381
gctcttccagaggcaagaccaaccaagatgagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 139577 - DNA, 5789 bp, Homo sapiens
  Payload ID: 7375
  Gene Symbol: HRK
  Gene Name: harakiri, BCL2 interacting protein
  Uniprot ID: O00198
  ENST ID: ENST00000257572
  CDS Start-End: 135-410
gcacaacacaaggagaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatattacgtatcagtgcatgccttgttgaggacgtggttgccttccttttctgcaccttgcgatgtgaactttgatattctgtaatgtctggggcgccagaagagagatgcctgctgtgtacttagaaactatttgcaaagactggtgggaattagccccagcatcggccaactgcctggggatagatgctggtggaataagaggtaacagtgcaaaaggcatgatagaaaaaaaaagtgaggacttgggaccgattgtgtaggggcagtctgggatgcctccatttcttgactcgtcctagcctctccctctgtacttacctaggtcgatcgctagatcccactgtcacgtcaagagaaatgggatttttgtgtctctggtgcttcacttaaaattttgctggtgctaagtgcgttcctgctggtgctgctgtggtattctgttgacagacttggaaggccaggggacaagagagatttctattttgctgtttcagattcttttttttttttttttaagggacaagttgcaaaagtgccacttgagagtctcttctcttcttctacctggggacgaatatccagaggtggtttggagcaaaccttggggtctaggagggaggatggcattgagaggcttgctggttatgaggcagaaagctgacctcatgcatgacttggttgctatctcccccacccccacaaaagtgtcctcggagttcagcccacagcctcctccactccccaaggggatttcagggtttaggttttatggattaaagagccaagaaatggctacattctgttcaaagatgatttataaccgggggatgttgtgggagggagtgggccatttaaatgaaatgcaccagcatctcactgattgacagaggtctgatttttttccccccaaggataagctactattttcagaagtttctagaagggctaaaaaaagatgtgtgctggacggagacttggctgcaaagactcttcagggagcagtgattattttttgctttcattttcgaaaaatccaacataagcaggtattcttcctctgtgcaggataccacacactgccattttcaaagccgaggtggcgaggtgtcaggctgcagattcggacggtcattctccaaggctggatttgcaggtcaccacccggtacctatagacagagggtccagcaggctggttagcagacaccgctccagttctaagacgccagcagtgggatccatgtttaaggtggatgcggctgaaatgggaattatccccccacaggctttgctgtacagttctaagaagccagcagtgggatccacatttgttaaggtggatgcggctgaaatgggaattatccctccataggctttgctgtaaatgaccaggtcctttagaatgtacaacctctcagtgctgctgcaagctgggagctggatttctttctgtcttccttttaaaatccgttccttgtgttttcctaaatagccctttaaagagaaatgcaaccccagggctgctgaatgccagggaagactcccccaccccgcagctttgaactcagcaaaccaaaaaaaaaaaaagaagaataatgcttattttgggagaacgtgtttctcctcattactcgtgccctccccctagctgatgtttgcaggggaccctcgcttagctggggactgcagagagcagtgggtaatattcccacaaagctacgaacttagagaaggcaaattcattagaataatatgaaatacagtcactgcttctatttaatcactttcttagccacagactagggtctttccagctccccccattttctggggaggggcgtccattactacacagctgtatccaatcacagttctctgcttctttaaggctgtaccttcaagatcgtagtgggggcatgctgaccacctgtagacacaggagaagatgaaaggtgagaggatccctttttcagccccgacttgcctactggcttttgatgtttcccctggaggatacaaactccaaacgctggggttggcattttgggtgattttgatttcaatgaagccactttgctgagagaactggggcacccacgacctcctgatagagcttctcagccaagtcccttgtagatattctcctgttttattagagaccacgtatttatcgaatcctgacctttccttgcacatcattcattggagtgcacttctcgactgccccgatttttgacacggggttgtttttaatgcttgtttttatatgagatttgacttcttgatggacatttgtattaggaaattgaagcatgatatatatgtatatattgtctccaccatctctcctgttgtattacttggattgcatgagatagtggggtggttcttgttttttaaaaaatatttccacagtgtgcaaagtgctggcaacatccctccctctcctccaccgctcccccacttttctctggctgccaaggagtcattgattttgattagcttcactgcagagcgtctgtgaagagagagagagagaaagggagggaggctttgaaataaattttaaaaaagacctcatatcgggtttcagcagacagcagtgtgtgtgtgtgtgtgtgtgtgtgtgtgtgtgtgtgtgtgtgtgtgtgaccgtacaagcagagggaggcctctgagatcatcgtttaggtagcttgctgcataatgagatgaagagacttttgcctcttcatttctgatggtgctgcttgctctcagagagtggggagccaggaaccgctgggactggagcccccgggacttcaacactccgaatgagatccagtcctttctggaagcttctcacccccacctgatctcccacaaacaaatacaatctcttcaaatttgggggtccgtttcctattctctttgttattggtgtagcttgagtaggaagtttctctggggagcccattggccccaatggctgctgtccatggtcctaggccgtgcgcatgtcctagaccccagttcctgttttgtttttttttgggttttttttggccctgcgcatctcttagagcccagttcctgtttttttgttcgttttttttttttttttttagccgccttcatttggatactggggacttcttttccacttcttcttcttcttctattttattttgagacagagtctcactctgtcacccaggctggagtgcagtggtgcgagctcagctcactgcaacctccacctcccaggttcaagcgattctcctgcctcagcctcctgagtagctgggattacaggcacccaccaccacgctcggctaatttttgtatttttagtggagatggggttttaccatgttggccagagtggttttgaactcctggcctcaagtgatccacctgccttggcctcccaaagtgctgggattacaggcatgagccaccgagctcagcctccacttcttattttgattcttttctgttttgatggtgagaggaaagggtgatttacccaatactgtcacagaaaaatgaaactgtgactggttttcacaatgtatgtagctgatctcatgttctcctattattatgtttctgacagtgataaaatatcactctccctccctggggcattagaggagtcctcacccacccacctcctacacaagtatcttttagggacagtggctcaccattgtggactttttgagtgtccacctgatattacaagttgcattgaccagaacacagattttgctcttctgtgtcaatacccatttcttttctgaaggtcagaagttggttaagggtttgggggaccagctagacactcttcttagtcccatggagctgactggaagttccatgaggggaggaaattgatgtcaaagtgtcattttaaagcttaagctgaaagtttattttttaaattctcattcattcatttagcatatattgattgagcatctacaatgtgccagttgtagaattccatctcagaagagacttgacttgtggatggtggaggggcagtcctgctcggaagcagatgatgtgaaatgttcctttccagtctggttcacgatgtttaacagatttgtcaggtcaccactgtgaccccaagctttgctggcagattgttatatagtatttactgagagccctgctatctggtaaaggcagttaaaaagcctgcaatctcgactcatttccagcatgaacagactggtccttgctgctttacacaataatcaaagctaccttttatggcgtgctcgccactcccaagcactgggcgaagtgctttacccgtcttcccctccgcgatgcctcatgcccactttagcagatagtactgttagcattcccattttacagtggaggaagctgaggctcagagaggttaagcaacttagctgaaggccacaccaccagcgaagtgcctgagccaagatttggactcgagtccatgggacccccacgctcgtgagctgactgctctgctccactgggtcccttcatgaggtcgtcccacagcactgctagttccagggcgagtgccagcacatggccccactgggagccggggcctgacttaggtctactggaaaaagtgtcacctttggggacactcaaggacaggctggttggtttcgttgtggattttatatactcatgccctaaccctgtgttcctggtttctataaggccccggggaaggtgcaaggaatttgcaaatagggcctgtatgacttatttcctaggacacgggaagcttttcttacctcctttctaccctcttctccaacctgaactcccaagtttcttctcctgaaggtctttgcactataagcgccaaggagcccgtgtgcgtggcaggggcggctgggagggtatctggagaaccttagtgaggcctctggcctagccagagaggcaataagcttggggacgttccgttctgggttctgacgttgttggttctgacgtcgttgtgctcttttgtaagaggaatttcataccttggagacgctttgtacatatttgtaatgactttattaaaaaactgattgtgcacttcta

SEQ ID NO: 139578 - DNA, 587 bp, Homo sapiens
  Payload ID: 7375
  Gene Symbol: HRK
  Gene Name: harakiri, BCL2 interacting protein
  ENST ID: ENST00000550505
  CDS Start-End: 1-57
gcggccgcgcaggtggcggcgctggcggcctggctgctcggcaggcggaacttgtaggaacgcggggcttcttggtggggccggagccgagacccagccggagcgagcaacagcctacatctgacctcagaataccagccgctccggcctttcttgtgcttttgatttaatttggggaaactcattttttcccagctctgagccccaggggaggctcctctgaggctggggaggcctggaggaggatgggtatgatttaaccagtcaatactcaaagatacaggagagagggaacaaaagacgctttatggtggttgagatcttcccatgtcaacacgcaaaggttttcctcatcctttttaatggctgcatgatgttctgttgcttggatgaaccaggatttccttatatggtcacttccttgggaacatttgcattgtttcctgttttctggttggtgaaaaccctgtgtccttggagaaagctggttcccgttttccagagggggagcccagagcttgaaaggccgcggttggcacttcgagaaggaagtggagagtaaagacagcgcctggagcgatcgtaga

SEQ ID NO: 139579 - DNA, 1967 bp, Homo sapiens
  Payload ID: 7376
  Gene Symbol: HARBI1
  Gene Name: harbinger transposase derived 1
  Uniprot ID: Q96MB7
  ENST ID: ENST00000326737
  CDS Start-End: 249-1298
gttgcgcgccgtggcggcctctgtgcagtcgccggttccggaggagggcccaacccggctgggtgggtgggaagtgtggctggtaacctggcagccgcggagagagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacggcagttcatttattacttggtggagctcttgggggcgaatctttctaggcctactcagcgatccagggctattagcccagagacacaggtccttgcagcattgggtttttatacctcaggttccttccagactcggatgggagatgccattggaatcagtcaggcgtctatgagtcgttgtgttgccaatgtcactgaagcacttgtggaaagggcctcacagttcattcgctttccagctgatgaagcctccattcaggctctgaaggatgaattctatgggttggcagggatgccaggggtgatgggggtggttgactgtatccatgtggccatcaaggcaccaaatgctgaagacctctcctatgtgaaccgaaaaggcctgcattctttaaactgcctgatggtgtgtgacattagagggacactaatgaccgtggagacaaactggcccggcagcctacaggactgtgctgtgctgcagcagtcttccctcagtagtcagtttgaagcgggtatgcacaaagatagctggcttctgggtgacagttccttctttcttcgaacctggctcatgaccccacttcacattcctgaaactccagcagaatatcgctataacatggcccattctgcaactcacagtgtgattgagaagactttccgaaccctctgctcccgattccgctgcctggatggatccaagggggcactgcagtactcaccagagaaatccagccatatcatcttggcctgttgtgtcctccacaacatctccctggagcatgggatggatgtttggtcctctccaatgacaggacccatggaacagcccccggaagaggagtatgagcacatggagtccctggacttagaggctgaccgtattcgtcaggagctaatgctcactcattttagctaatgtagaaggtggagaggagggatacttcccaggagttgtgacagactttcctcctcatcaccttttacacagttccatcatctagcatgactgagtatacagatacttgtcataaactgacatttaatatgtgtgttttggtaaggttggggctatgccagaatatcttgattcatttgcatatgcattaattaaactgaaaccaagacagcggctccctactatccagtgaactctaggttgagtaccactaatttgaaagctcagtggttgcaaacatttatgactgtgcctacaaagtcatagtaaaggtcaggagttcaagacaagaccagcctggccaacatggtgaaaccccgtctctactaaaaatacaaaaattagcggccgggtgcggtggctcacgcctgtaatcccagcactttgggaggccgaggcgggcggatcacctgagttcaggagttaagaccagcctgggcaacatggcaagaccctgtctctactaaaaatacaaaaaaattagctgggcgtggtgacaggtgcctgtaatcccagctactcggtaggctgaggcaggagaatcacttgaaccagggaggcggaggttgtggtgagccgagatcgtgccattgcactccagcctaggcaagaagagcgaaactccgtctc

SEQ ID NO: 139580 - DNA, 717 bp, Homo sapiens
  Payload ID: 7376
  Gene Symbol: HARBI1
  Gene Name: harbinger transposase derived 1
  ENST ID: ENST00000529192
  CDS Start-End: 492-717
ttttttttttttttttttgccccttcttttcttgttagactggtttgaacaccccagcatctgtcctgtatttgtcaggtgaaaccagaagtctttggataatgaaacccgtgaccaattcttacccaaggtggttatgacatatgtcagctgcttcttggcctatatagttagaagccgacctcttttaccttgtgaataattatgtcatcacctccattattcttttggtgttctcaattgaaatgccaagcattaaatgagccacaaagattgaattcccattatccttgaatcagagcaagcctgtcgtgcagccatgagttagtggagaaaaatccggagttagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacggcagttcatttattacttggtggagctcttgggggcgaatctttctaggcctactcagcgatccagggctattagcccagagacacaggtccttgcag

SEQ ID NO: 139581 - DNA, 620 bp, Homo sapiens
  Payload ID: 7376
  Gene Symbol: HARBI1
  Gene Name: harbinger transposase derived 1
  ENST ID: ENST00000532281
  CDS Start-End: 493-620
cccccgcaaaagttagtacctgcgaagctgcggcacaaagagtggttccgggctctcattacggaggccgggacctgggaccgaccagccgcgcctcctggctgagggttccgcgctccggagctgcagtgaccgtacacgtcgccgatagacacctaaggcttcagaagggtcctggctcgcaggccccagacgttttgctcctaagactccgcgagttgtcgcacccacgtcgactggcgctcttcagtgcttccctcactggttaagcggtcactcccgccttaagcccagcagccggtcgcttcccggcgccgccatcgttagtgtttgttttcatccgcttcgagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacg

SEQ ID NO: 139582 - DNA, 894 bp, Homo sapiens
  Payload ID: 7377
  Gene Symbol: HRAS
  Gene Name: Harvey rat sarcoma viral oncogene homolog
  Uniprot ID: P01112
  ENST ID: ENST00000311189
  CDS Start-End: 173-742
cccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcc

SEQ ID NO: 139583 - DNA, 1099 bp, Homo sapiens
  Payload ID: 7377
  Gene Symbol: HRAS
  Gene Name: Harvey rat sarcoma viral oncogene homolog
  Uniprot ID: P01112
  ENST ID: ENST00000397594
  CDS Start-End: 54-566
gtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 139584 - DNA, 1100 bp, Homo sapiens
  Payload ID: 7377
  Gene Symbol: HRAS
  Gene Name: Harvey rat sarcoma viral oncogene homolog
  Uniprot ID: P01112
  ENST ID: ENST00000397596
  CDS Start-End: 137-706
gggggcgcggggccggcgggcgtaagcggcggcggcggcggcggcggcgggtgggtggggccgggcggggcccgcgggcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 139585 - DNA, 1233 bp, Homo sapiens
  Payload ID: 7377
  Gene Symbol: HRAS
  Gene Name: Harvey rat sarcoma viral oncogene homolog
  Uniprot ID: P01112
  ENST ID: ENST00000417302
  CDS Start-End: 189-701
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttg

SEQ ID NO: 139586 - DNA, 1151 bp, Homo sapiens
  Payload ID: 7377
  Gene Symbol: HRAS
  Gene Name: Harvey rat sarcoma viral oncogene homolog
  Uniprot ID: P01112
  ENST ID: ENST00000451590
  CDS Start-End: 189-758
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttg

SEQ ID NO: 139587 - DNA, 1114 bp, Homo sapiens
  Payload ID: 7377
  Gene Symbol: HRAS
  Gene Name: Harvey rat sarcoma viral oncogene homolog
  Uniprot ID: P01112
  ENST ID: ENST00000493230
  CDS Start-End: 177-689
gcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 139588 - DNA, 1233 bp, Homo sapiens; identical to SEQ ID NO: 139585
  Payload ID: 7377
  Gene Symbol: HRAS
  Gene Name: Harvey rat sarcoma viral oncogene homolog
  Uniprot ID: P01112
  ENST ID: ENST00000616241
  CDS Start-End: 189-701

SEQ ID NO: 139589 - DNA, 1151 bp, Homo sapiens; identical to SEQ ID NO: 139586
  Payload ID: 7377
  Gene Symbol: HRAS
  Gene Name: Harvey rat sarcoma viral oncogene homolog
  Uniprot ID: P01112
  ENST ID: ENST00000610977
  CDS Start-End: 189-758

SEQ ID NO: 139590 - DNA, 894 bp, Homo sapiens; identical to SEQ ID NO: 139582
  Payload ID: 7377
  Gene Symbol: HRAS
  Gene Name: Harvey rat sarcoma viral oncogene homolog
  Uniprot ID: P01112
  ENST ID: ENST00000615062
  CDS Start-End: 173-742

SEQ ID NO: 139591 - DNA, 1099 bp, Homo sapiens; identical to SEQ ID NO: 139583
  Payload ID: 7377
  Gene Symbol: HRAS
  Gene Name: Harvey rat sarcoma viral oncogene homolog
  Uniprot ID: P01112
  ENST ID: ENST00000631967
  CDS Start-End: 54-566

SEQ ID NO: 139592 - DNA, 1114 bp, Homo sapiens; identical to SEQ ID NO: 139587
  Payload ID: 7377
  Gene Symbol: HRAS
  Gene Name: Harvey rat sarcoma viral oncogene homolog
  Uniprot ID: P01112
  ENST ID: ENST00000634098
  CDS Start-End: 177-689

SEQ ID NO: 139593 - DNA, 167 bp, Homo sapiens
  Payload ID: 7377
  Gene Symbol: HRAS
  Gene Name: Harvey rat sarcoma viral oncogene homolog
  ENST ID: ENST00000633700
  CDS Start-End: 124-167
tcactgggtcattaagagcaagtgggggcgaggcgacagccctcccgcacgctgggttgcagctgcacaggtggggcaggagaccctgtaggaggaccccgggccgcaggcccctgaggagcgatgacggaatataagctggtggtggtgggcgccggcggtgtggg

SEQ ID NO: 139594 - DNA, 1100 bp, Homo sapiens; identical to SEQ ID NO: 139584
  Payload ID: 7377
  Gene Symbol: HRAS
  Gene Name: Harvey rat sarcoma viral oncogene homolog
  Uniprot ID: P01112
  ENST ID: ENST00000631404
  CDS Start-End: 137-706

SEQ ID NO: 139595 - DNA, 1125 bp, Homo sapiens
  Payload ID: 7378
  Gene Symbol: HAUS1
  Gene Name: HAUS augmin-like complex, subunit 1
  Uniprot ID: Q96CS2
  ENST ID: ENST00000282058
  CDS Start-End: 81-917
ggcgtgtgggcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 139596 - DNA, 1098 bp, Homo sapiens
  Payload ID: 7378
  Gene Symbol: HAUS1
  Gene Name: HAUS augmin-like complex, subunit 1
  ENST ID: ENST00000591715
  CDS Start-End: 17-259
ggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaaggtgagattaagtccagagttttgaacgagaataaatagagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctc

SEQ ID NO: 139597 - DNA, 879 bp, Homo sapiens
  Payload ID: 7378
  Gene Symbol: HAUS1
  Gene Name: HAUS augmin-like complex, subunit 1
  ENST ID: ENST00000592206
  CDS Start-End: 13-228
ggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagttttcttttaaaagttaatatacagcagggccaggtgcagtggctcacgcctgtaatcccagcactttgggaggccaaggtgggcggatcacttgagaccaggagtttgagacaagcctggccaagatgccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccg

SEQ ID NO: 139598 - DNA, 1079 bp, Homo sapiens
  Payload ID: 7378
  Gene Symbol: HAUS1
  Gene Name: HAUS augmin-like complex, subunit 1
  ENST ID: ENST00000593165
  CDS Start-End: 1-284
aggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagagtcatgctctgtcgcccaggctggagtgctttggtgtgatctcagctcactgcaacctccgcctcttgggttcaagcaattctcctgactcagcctcctgaataactaggattacaggcacatgccaccgtgctcagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattac

SEQ ID NO: 139599 - DNA, 523 bp, Homo sapiens
  Payload ID: 7378
  Gene Symbol: HAUS1
  Gene Name: HAUS augmin-like complex, subunit 1
  ENST ID: ENST00000586060
  CDS Start-End: 28-312
cctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagggatgtcaagaaagcagagttgcatctgtctacagaaagggccaaagttgataatcgtcgtcagaacatggactttctaaaagcaaagtcagaggaattcagatttggaatcaaggctgcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaact

SEQ ID NO: 139600 - DNA, 616 bp, Homo sapiens
  Payload ID: 7378
  Gene Symbol: HAUS1
  Gene Name: HAUS augmin-like complex, subunit 1
  ENST ID: ENST00000589554
  CDS Start-End: 7-291
gcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaa

SEQ ID NO: 139601 - DNA, 506 bp, Homo sapiens
  Payload ID: 7378
  Gene Symbol: HAUS1
  Gene Name: HAUS augmin-like complex, subunit 1
  ENST ID: ENST00000585518
  CDS Start-End: 11-382
agccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggacttta

SEQ ID NO: 139602 - DNA, 357 bp, Homo sapiens
  Payload ID: 7378
  Gene Symbol: HAUS1
  Gene Name: HAUS augmin-like complex, subunit 1
  ENST ID: ENST00000592471
  CDS Start-End: 35-357
aggagttcctagtaaagtggcgggagccgcagctatggagccgcaggaggagagagaaacgcaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatct

SEQ ID NO: 139603 - DNA, 3949 bp, Homo sapiens
  Payload ID: 7379
  Gene Symbol: HAUS2
  Gene Name: HAUS augmin-like complex, subunit 2
  Uniprot ID: Q9NVX0
  ENST ID: ENST00000260372
  CDS Start-End: 64-771
gccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcaagtgatcctcccacctcagcctcccaagtagctgggactataggcacgcgccaccacgcctggctaatttttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaa

SEQ ID NO: 139604 - DNA, 2853 bp, Homo sapiens
  Payload ID: 7379
  Gene Symbol: HAUS2
  Gene Name: HAUS augmin-like complex, subunit 2
  ENST ID: ENST00000391623
  CDS Start-End: 36-317
actcttggcgccttcgcggaaggtgcgtccgagccatggccgctgccaacccgtgggacccggcgtccgcgcctaacggcgctgggctagtgctaggccacttcatagcttcggggatggtcaatcagaaaaacctggaaattgaactcctgaaactagaaaaagatacagcagatgttgttcatcctttctttttggagatgaagtcttgctatgttgcccaggctggtctcgaactcatggcctcaattctcccgtttcagtctcccaaaacactgcgattacagctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgat

SEQ ID NO: 139605 - DNA, 626 bp, Homo sapiens
  Payload ID: 7379
  Gene Symbol: HAUS2
  Gene Name: HAUS augmin-like complex, subunit 2
  ENST ID: ENST00000564279
  CDS Start-End: 16-390
aggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggagatgaagtcttgctatgttgcccaggctggtctcgaactcatggcctcaattctcccgtttcagtctcccaaaacactgcgattacagctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggat

SEQ ID NO: 139606 - DNA, 861 bp, Homo sapiens
  Payload ID: 7379
  Gene Symbol: HAUS2
  Gene Name: HAUS augmin-like complex, subunit 2
  ENST ID: ENST00000570178
  CDS Start-End: 7-294
cgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctt

SEQ ID NO: 139607 - DNA, 575 bp, Homo sapiens
  Payload ID: 7379
  Gene Symbol: HAUS2
  Gene Name: HAUS augmin-like complex, subunit 2
  ENST ID: ENST00000562398
  CDS Start-End: 36-575
actcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggagatgaagtcttgctatgttgcccaggctggtctcgaactcatggcctcaattctcccgtttcagtctcccaaaacactgcgattacagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaaca

SEQ ID NO: 139608 - DNA, 590 bp, Homo sapiens
  Payload ID: 7379
  Gene Symbol: HAUS2
  Gene Name: HAUS augmin-like complex, subunit 2
  ENST ID: ENST00000563479
  CDS Start-End: 36-251
actcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaa

SEQ ID NO: 139609 - DNA, 1702 bp, Homo sapiens
  Payload ID: 7379
  Gene Symbol: HAUS2
  Gene Name: HAUS augmin-like complex, subunit 2
  Uniprot ID: Q9NVX0
  ENST ID: ENST00000568876
  CDS Start-End: 46-660
gatcccgctcactcttggcgccttcgcggaaggtgcgtccgagccatggccgctgccaacccgtgggacccggcgtccgcgcctaacggcgctgggctagtgctaggccacttcatagcttcggggatggtcaatcagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaa

SEQ ID NO: 139610 - DNA, 592 bp, Homo sapiens
  Payload ID: 7379
  Gene Symbol: HAUS2
  Gene Name: HAUS augmin-like complex, subunit 2
  ENST ID: ENST00000567640
  CDS Start-End: 46-237
gatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagagatgaagtcttgctatgttgcccaggctggtctcgaactcatggcctcaattctcccgtttcagtctcccaaaacactgcgattacagctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattg

SEQ ID NO: 139611 - DNA, 709 bp, Homo sapiens
  Payload ID: 7379
  Gene Symbol: HAUS2
  Gene Name: HAUS augmin-like complex, subunit 2
  ENST ID: ENST00000568846
  CDS Start-End: 40-321
gctcactcttggcgccttcgcggaaggtgcgtccgagccatggccgctgccaacccgtgggacccggcgtccgcgcctaacggcgctgggctagtgctaggccacttcatagcttcggggatggtcaatcagaaaaacctggaaattgaactcctgaaactagaaaaagatacagcagatgttgttcatcctttctttttggagatgaagtcttgctatgttgcccaggctggtctcgaactcatggcctcaattctcccgtttcagtctcccaaaacactgcgattacagctcagaagtgtcatactctgcaaagcatgaataatcatttggaagcagtgctgaaagagaagagatcccttaggcaaagactgttgaaacccatgtgccaggaaaacttacctattgaagctgtttatcacaggttagactgaaaagtagaaattaacagttacacctgttttctgagtttactttttgttttgcagttactttgtagcagaattcataaaacaattagtgattgtatttgttaacattattaatggtgatatattaaatcagaaagaaaatctttgcttttaaaccattatacctatggcaaaaaggaagaacttggccatcgtgttttgggaattataaattatgagtttaatgaaagaaattagatccataacatgtaacaataaaaactgtttgtatgtgaagt

SEQ ID NO: 139612 - DNA, 443 bp, Homo sapiens
  Payload ID: 7379
  Gene Symbol: HAUS2
  Gene Name: HAUS augmin-like complex, subunit 2
  ENST ID: ENST00000607467
  CDS Start-End: 1-168
gatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacaggttagactgaaaagtagaaattaacagttacacctgttttctgagtttactttttgttttgcagttactttgtagcagaattcataaaacaattagtgattgtatttgttaacattattaatggtgatatattaaatcagaaagaaaatctttgcttttaaaccattatacctatggcaaaaaggaagaacttggccatcgtgttttgggaattataaattatgagtttaatgaaagaaattagatccataacatgtaacaataaaaactgtttgtatgtgaagt

SEQ ID NO: 139613 - DNA, 5620 bp, Homo sapiens
  Payload ID: 7380
  Gene Symbol: HAUS3
  Gene Name: HAUS augmin-like complex, subunit 3
  Uniprot ID: Q68CZ6
  ENST ID: ENST00000243706
  CDS Start-End: 231-2042
ctcccgtgaggcagtgcgaggcgcgcggggcacggagggcggtggcggcgggctcctgcgagaagcaagcggaacttcctgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaatttgaggtcaatggaacatttaatttgatgaattgaactattatattaatttgtcttttttctcatgtagtacattcagaataccagtgctttttatgacttgagcatgtgtttagtggtacttagtcctggtaattttttacttacagggaaaaagcattattacataatgcaaatattttttaatatagttatctctctcctttttagaaatagaaattttctgccgttaaatttttttttgagatagagtctcactctgtctccaggctggaatgcagtggcacgatcttggctcactgcaacctctgcctcccgggttcaagtgattctcctgcctcagcctcccaagtagctgggactacaggcgcacaccgccacacccagctaatttttttgtattttagtagaaaaggggtttcaccatgttggccaggatggtctcaatctcttgacctcttgatcccctctcccggcctcccaaagtgccggaattacaggcatgagccaccacgctcagccgctattaaatattttaaaatgtgtagaacttctagtcagcatttttaaatctgtagaccttaatatgtgaaatagccaagtcccctcatgtttgactgtcaaataaaattctgctgctcaaattgtattcctccataattccctgctatagacctttaggctgttttaatgtccctacttgtaccacagagtattaggacttccttggcctgcctgcattcattttagagtctgaattctggggactcaaaagtttctacaagacagctgagcagtgctttgactttaatgtgacttacacatcataaatgactttcaaatgaaatttgaatttcaaaattctgtaaaagtggttgctcaaaagatgtatgatactattttaatcagtttaagagcaaaaatgtctaattgtatttaacaatggtatttgggcagccagaaaatattttaagcgttgctctaaaataatttgaagtagctcatctgttattacatcagatgcttcttgagtgcccaatttatacatggcctgtggtaaataccatgtgagctttgtaggaatacctttaagaatattcctcacctgttcgtaatatggaatgccaatctaaaaactacatgttttgggtggtctttatggaattttttagctataaccatcagaaaacaggcatacctagatgacagatgaaccttcttgatttttgaaacccattgaacaaaaatattttgccaattattgtgtttatgttatttaaaattttatgtaaaccttaattttgtagcagtaaattttgtttaagattttgctatcagctccctatcacctgagcaactttttttttgttgtatatgtttttttctattctatttcggaatagagaatttacttaaaatttttattttctccaaaaatgtggaaaatatgtcacctggtttcctggtttatggtagcatattctgtttaaattagtgtcacatatttagatgtgtggccagacgcttgatttattagttaatttttgagacagagtctaactgtgtcactcaggctggagttcagtggaatgatctcggctcactgcaacctccgcctcccaggttcaagtgattctcctgcttcagcctcctgagtagatgggattgtaggcgtgcaccactgcacctggctaatttttgtattttcagtagagacggggtttcaccatgttggtcaggctggtctcaaactcctgacctcaagtgatctacccgccttggccttccatagtgctggcattacaggtgtaagccaccatgcccctgcccagatgcttgatttatactgtccccacccaaaccttgacttgctcagcccagggggccagcagggcagatcaaggcacggatggtagttgtgtgtctgccgtaattacccaagttacttataatcgttgtgttactaggtaggtttatttgaagatttatttatttatttatttattttttattttttgagacggagtttcactcttgttgcccaggctggagtgcagtggcatgatctcagctcactgcaacctctgccttctgggttcacgtgattctcctgcctcaggcctcccgagtagctgggattacaggtgccaccatgcctggttaattttttgtatttttagtagagacggggtttcatcatgttggccaggttggtctcgaactcctgacctcaggtgatccacccgcctcagtctaccaaagtgcagggatcacaggcatgagcttccgcgctcagcctatttgaagatttaataacatttttcaaacctcaggatgtatttgagtagattgcttctaaattggtcacctagaaaataagttatctatttactatgatacctggattaagcctctagctattttgcttttttctttctatctatattattggatgattgatgcctattttctgtggttatgaatatagacattttaaatgaaagttggtatataaatttttgaaaataattgtatttcctgttttatagtcttaggattaatatatgggatttatcttatgttaatcttacatttaggattttgtgaaaatggaaaattatgaggcattggtaggctttgatctctgtaatacaccgctctccagtgttgctcagaagattatgtctgctatgcattcaggtgatttagtggattctaagacttggggaaagagtacagagagtaagtaatttttatgaacctttctttctcttgatactttgaatgttaattgttctaaagactaagaattgaaaatggaatgcatgtagacagatgaagcccagctcccgccccttttacactcattcagtgcagactgagcttctgcttgctaactttcgtgttcccttaaccttcattgctttaaaaatgtaacactctcttccttattccaggtatttctgtcaaacattcccttagaatctggatcaggtattttagtattttcaaaagagatgctttaatcttggttctcaggtcatcaaacctgtacatagtatttgctattttgtgtggtgaacaagagatatgtttttgacaatatgtgtattgtgctgctatagaaatgtaaactcttaggtggcaaggattattggatcagtgtatatggatttatgatgtggtataatagtaaaagcagtggggccgggtgcggtggctcacgcctgtaatcccagcactttgggaggccgaggtcggcgatcatgaggtcaggagatcgagaccatcctggctaacacggtaaaacactgtctctactaaaaatacaaaaaattagctgggagtggtggtaggcgcctgtagtccagctacttgggaggctgaggcaggagaatggcatgaacccaggaggcggggcttgcagtgagctgaggtctccagcgtgggcgacagagtgagactctatctcaaaaaaaaaaaaaaaaaaaa

SEQ ID NO: 139614 - DNA, 2430 bp, Homo sapiens
  Payload ID: 7380
  Gene Symbol: HAUS3
  Gene Name: HAUS augmin-like complex, subunit 3
  Uniprot ID: Q68CZ6
  ENST ID: ENST00000443786
  CDS Start-End: 533-2344
gtcgccttgtgcgcttgcgcgcgtccaggcgctcccgtgaggcagtgcgaggcgcgcggggcacggagggcggtggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaa

SEQ ID NO: 139615 - DNA, 580 bp, Homo sapiens
  Payload ID: 7380
  Gene Symbol: HAUS3
  Gene Name: HAUS augmin-like complex, subunit 3
  ENST ID: ENST00000514395
  CDS Start-End: 481-580
agtgcgaggcgcgcggggcacggagggcggtggcggcgggctcctgcgagaagcaagcggaacttcctgaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcg

SEQ ID NO: 139616 - DNA, 3166 bp, Homo sapiens
  Payload ID: 7380
  Gene Symbol: HAUS3
  Gene Name: HAUS augmin-like complex, subunit 3
  Uniprot ID: Q68CZ6
  ENST ID: ENST00000506763
  CDS Start-End: 750-2219
agtgcgaggcgcgcggggcacggagggcggtggcggcgggctcctgcgagaagcaagcggaacttcctgaggtgactgacgcgggcctcggttctgggcgcaggggtgtggggctggaggagtggccgcgatccccgtctgcacccaggtgcctcttttttttcctgcgctcctgggggctccttccaggtgctccagcagctgcccggggatcagggcccggtccgctgggcgaggagctggggcgggggctgtgcggggcctgtcacccccgtcttctgcagctcggtgtcgacggcgattcggtgggcttgtgcgtttgttttgtcagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgaggcaggagaatggcatgaacccaggaggcggggcttgcagtgagctgaggtctccagcgtgggcgacagagtgagactctatctcaaaaaaaaaaaaaaaaaaaagtgaaagcagtgatatgctcacaaatgtcactgaaatgtttataacatcagggcttttggtgtttttttgttttgttttttgttggtgttttttttttttttttgctactagcaaagcagtttttattttaaatttgcaagcctgggccaatagtttgtggttggtttctctttctacaaaataaggtataagtgagtgagatataattgagtaatgaaattgcattgaaataattgagagtattgccgaatattagcacaaaagctcttataaacacatcttgattaagatacatttgcacttaacgttttgatccattcatattgaggcatctgttgcttatatactttattatagtagaagtcactaataaactggtaagaatttttgagtgtgaattacatgcctagcaattgatagtgtaagacactatcataatcacattattccatatttttttgaataatagagggtgcatacttgacagaggtggaaatatactccccttcaaaaaccggtaagaataatgaaatgcctctggcagctataatatgaggctctgatgaaaaatttacgacagtcagtccatctcatataagctcttattgttgttctaaaatacattgttaatgcctgggacgatcacttgagcccaggagttcgagtccagcctaggcaacatagcaagatctcatctctgaaaataaaataccccgttaaaattctggcttttgtttgttaaggttattgagaaggtaatagaaaaagatatgatactacttttctctcttggatttgtaaaaatagtggaattttcataaggattttgtattttctattgctgtataacattattaatacaaacttattggcttaaaaaacac

SEQ ID NO: 139617 - DNA, 574 bp, Homo sapiens
  Payload ID: 7380
  Gene Symbol: HAUS3
  Gene Name: HAUS augmin-like complex, subunit 3
  ENST ID: ENST00000502440
  CDS Start-End: 544-574
gtgaggcagtgcgaggcgcgcggggcacggagggcggtggcggcgggctcctgcgagaagcaagcggaacttcctgagctcggtgtcgacggcgattcggtgggcttgtgcgtttgttttgtcagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacat

SEQ ID NO: 139618 - DNA, 1642 bp, Homo sapiens
  Payload ID: 7381
  Gene Symbol: HAUS4
  Gene Name: HAUS augmin-like complex, subunit 4
  Uniprot ID: Q9H6D7
  ENST ID: ENST00000206474
  CDS Start-End: 254-1345
gccccgcctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccaggattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatctta

SEQ ID NO: 139619 - DNA, 1474 bp, Homo sapiens
  Payload ID: 7381
  Gene Symbol: HAUS4
  Gene Name: HAUS augmin-like complex, subunit 4
  Uniprot ID: Q9H6D7
  ENST ID: ENST00000342454
  CDS Start-End: 229-1185
ggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccaggattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatatt

SEQ ID NO: 139620 - DNA, 1428 bp, Homo sapiens
  Payload ID: 7381
  Gene Symbol: HAUS4
  Gene Name: HAUS augmin-like complex, subunit 4
  Uniprot ID: Q9H6D7
  ENST ID: ENST00000347758
  CDS Start-End: 426-1139
cctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatatt

SEQ ID NO: 139621 - DNA, 1637 bp, Homo sapiens
  Payload ID: 7381
  Gene Symbol: HAUS4
  Gene Name: HAUS augmin-like complex, subunit 4
  Uniprot ID: Q9H6D7
  ENST ID: ENST00000541587
  CDS Start-End: 250-1341
cctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatctt

SEQ ID NO: 139622 - DNA, 602 bp, Homo sapiens
  Payload ID: 7381
  Gene Symbol: HAUS4
  Gene Name: HAUS augmin-like complex, subunit 4
  ENST ID: ENST00000553859
  CDS Start-End: 1-435
cacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagt

SEQ ID NO: 139623 - DNA, 473 bp, Homo sapiens
  Payload ID: 7381
  Gene Symbol: HAUS4
  Gene Name: HAUS augmin-like complex, subunit 4
  ENST ID: ENST00000553420
  CDS Start-End: 1-443
tgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggttggcggggagatattggaaccaaataaatgaaatggtttaatttctcccatatctttaaaa

SEQ ID NO: 139624 - DNA, 652 bp, Homo sapiens
  Payload ID: 7381
  Gene Symbol: HAUS4
  Gene Name: HAUS augmin-like complex, subunit 4
  ENST ID: ENST00000554406
  CDS Start-End: 601-652
gggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggc

SEQ ID NO: 139625 - DNA, 1626 bp, Homo sapiens
  Payload ID: 7381
  Gene Symbol: HAUS4
  Gene Name: HAUS augmin-like complex, subunit 4
  Uniprot ID: Q9H6D7
  ENST ID: ENST00000555986
  CDS Start-End: 415-1371
ttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattg

SEQ ID NO: 139626 - DNA, 582 bp, Homo sapiens
  Payload ID: 7381
  Gene Symbol: HAUS4
  Gene Name: HAUS augmin-like complex, subunit 4
  ENST ID: ENST00000557591
  CDS Start-End: 102-582
tcccccagcccctgcgcccggcccgaacgagaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatga

SEQ ID NO: 139627 - DNA, 1107 bp, Homo sapiens
  Payload ID: 7381
  Gene Symbol: HAUS4
  Gene Name: HAUS augmin-like complex, subunit 4
  ENST ID: ENST00000555040
  CDS Start-End: 269-1107
gagtgtggccccgcctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgag

SEQ ID NO: 139628 - DNA, 1454 bp, Homo sapiens
  Payload ID: 7381
  Gene Symbol: HAUS4
  Gene Name: HAUS augmin-like complex, subunit 4
  Uniprot ID: Q9H6D7
  ENST ID: ENST00000555367
  CDS Start-End: 234-1190
ctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgatt

SEQ ID NO: 139629 - DNA, 1447 bp, Homo sapiens
  Payload ID: 7381
  Gene Symbol: HAUS4
  Gene Name: HAUS augmin-like complex, subunit 4
  Uniprot ID: Q9H6D7
  ENST ID: ENST00000490506
  CDS Start-End: 431-1150
gggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatctta

SEQ ID NO: 139630 - DNA, 983 bp, Homo sapiens
  Payload ID: 7381
  Gene Symbol: HAUS4
  Gene Name: HAUS augmin-like complex, subunit 4
  ENST ID: ENST00000554516
  CDS Start-End: 422-983
cacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcag

SEQ ID NO: 139631 - DNA, 578 bp, Homo sapiens
  Payload ID: 7381
  Gene Symbol: HAUS4
  Gene Name: HAUS augmin-like complex, subunit 4
  ENST ID: ENST00000556915
  CDS Start-End: 122-578
gagccccggcgcgggcgggttctggggtgtagacgctgctggccagcccgccccagccgaggttctcggcaccgccttgagagcttcagctgccccaggattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggattttgtgtggatgagggctcggctacagcaagaagtagaggagcagctcaaaaagaaatgtttcactctgctctgctactatgatcccaattcaggtgcttctccgctgcctcactttgctgcag

SEQ ID NO: 139632 - DNA, 4283 bp, Homo sapiens
  Payload ID: 7382
  Gene Symbol: HAUS5
  Gene Name: HAUS augmin-like complex, subunit 5
  Uniprot ID: O94927
  ENST ID: ENST00000203166
  CDS Start-End: 26-1927
gcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttct

SEQ ID NO: 139633 - DNA, 2758 bp, Homo sapiens
  Payload ID: 7382
  Gene Symbol: HAUS5
  Gene Name: HAUS augmin-like complex, subunit 5
  Uniprot ID: O94927
  ENST ID: ENST00000587439
  CDS Start-End: 52-924
cgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagtgagactggggctgccccacccctgccctgcatcccctgccatgggtgactgtcactccctgaacctcctcaaaaaagataaccccagacccccagtgttcccaggctgccagacctcacccttgggtcagcagccctggtcttggcatcctagtccccagacccaccttgaagttcctgggcccccagagcctccagaacccaaggcctcctctcagtccccacccaacccagacttctccccgcccgtaggttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttct

SEQ ID NO: 139634 - DNA, 883 bp, Homo sapiens
  Payload ID: 7382
  Gene Symbol: HAUS5
  Gene Name: HAUS augmin-like complex, subunit 5
  ENST ID: ENST00000590994
  CDS Start-End: 1-507
cccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttc

SEQ ID NO: 139635 - DNA, 4462 bp, Homo sapiens
  Payload ID: 7382
  Gene Symbol: HAUS5
  Gene Name: HAUS augmin-like complex, subunit 5
  ENST ID: ENST00000424522
  CDS Start-End: 33-302
gagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtgagaagcatatgctacaagattctctttcatccgaaaaatgacttgtagatcttctgctctaagcccaaccaggtgctgggtgatgctggggacaatgggtcacaagacagccttgatctccatcctcatagggcttaaagtccagtggaaacagcattagctcagccaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttct

SEQ ID NO: 139636 - DNA, 526 bp, Homo sapiens
  Payload ID: 7382
  Gene Symbol: HAUS5
  Gene Name: HAUS augmin-like complex, subunit 5
  ENST ID: ENST00000592291
  CDS Start-End: 25-207
cggtgtcgccgccgcggcgctgtcatggagctagcgcaggaagcgcgggaactgggttgctgggcggtcgaagagatgggggtgcccgtggcggcccgggccccggaatcgacgctgcgcaggaatgaggatcccacaccctgtgtgctgccccaggcatatgcttacacactgtccccacaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatg

SEQ ID NO: 139637 - DNA, 3756 bp, Homo sapiens
  Payload ID: 7383
  Gene Symbol: HAUS6
  Gene Name: HAUS augmin-like complex, subunit 6
  ENST ID: ENST00000380496
  CDS Start-End: 16-2424
gcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaagggtaaggtttaaatagacctatgcatattcacctgttgaagttttctctcaacttttgataaaaccagtacacaaagaatgctgcatgacctttattgttaatgtgctcccccttccttcatttaggatgaggggaatgatccctcactggacaggtcctttcagaatctctgtttatgtatatatagttacaattgatttgagacaggggtgggaaaaaaaagcccccccaatctgaagcttacaggttttataatacaaatgactgaaaagtaaatgtcatcaaaatcttgcccagtggaaggtggtttttaaacacttgagaaacccaattttaaatatcatcactataatggtgtaatatctgggggtggggtgtagaaataaaagaagccaggtcagtgtattagtttcctagggctgccataacaaagcaccatcaagtgggtggcttagaacagcagaaatttattgtctctggagacagtaagttctagaggctagatgtccaaaatcaaggtgttgacagggccatgttccctctgaagccactagaagaggatccttctttgcctcttctagcctctggtagcaccaggcattccttggcttgtggcagtgtaattctaatctttgcctccattgtcacatggtattcttcccttgtgtgtgtattgtcttataaggacacagtcatattagctaattaatgggtcaccctactccagtatgacctcatcttacttagctaattatatctgtaatgaccacatttccaaataaggtcacattctgaggtactggggttagaacttcaacatatgtttttgggggtattcagttcataacagttagtattaataattattgaagctaggtgatggatatattgagttaatcacagttctcttcacttttgtatgtttgaatgttttcctcataaaaggttaaaaaaattgctcttgtagctcattaagagagataaggatctggtgatacagattcattacatactctgatttgcccataatagttatacactgccatattgaaaagtatttggctgggcacagtggctcacacctgcaatcccagcactttgggagtccgagatgggaggatcacttgaacccaggagttcgagactagcctcagcaacacagggagactatgtctctacaaaaaattaaacaattagctgggcacgttggcgcatgcctgtgatcccaggtacacaggaggctgaggtgggaggattgcttgggcctgggagtttgaggctgaagtgagctgcgatcgtgccactgcactccagcctgggtgacagagcaagaccctgtcgca

SEQ ID NO: 139638 - DNA, 6536 bp, Homo sapiens
  Payload ID: 7383
  Gene Symbol: HAUS6
  Gene Name: HAUS augmin-like complex, subunit 6
  Uniprot ID: Q7Z4H7
  ENST ID: ENST00000380502
  CDS Start-End: 469-3336
agaaacccgaaggcccgaggatctgggcacgacagcggttaagcaagcgcagagcaagtcgctggccgcgcaatgcccggtgggtcttgcagtttcttggctgggcatggccggaagggaggagagaaggacgcattgcatggcgggagatatagtctttgccggaagtccctcctccctcggacgcctggcggcgccggcgcacactgctcttccttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaaatggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgatggcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggctaatttattactctaagtggatttcttattacattaatatcagacatatagaatgtactttgttttactatttgtaagatacaaaggtatataaactgacatacatcagcttgaaacctgagataatgctaaaatgttctaattattttaaatgtttaaagaggacaaccatgtaatgttgctaaacatgaaaaatgtcatcaagtggaataaagaatagctgaagttaacatttgggggaaattgagctgaaaacaaaaatatgagtattttgataccttttctttaccatgagactcttgactatgaagtcaaatttatctaaaggaaaaacaggaattctggagacctgtgtaaaagcagactattatcttcctactgtgagagtactaaaattaaaatacgtttaatgacgttttcctcaatgtaaaagcattgaagtaaatgtttcttttatgttgcagatacatagttgctctagagatcacctttttctttatgcattgtgaatagcagtctgcatcctaagtttaaaatatttgagaatcctctatgggactctctgtaaatgttttaaatactgttgttttcaataaatattttatacta

SEQ ID NO: 139639 - DNA, 680 bp, Homo sapiens
  Payload ID: 7383
  Gene Symbol: HAUS6
  Gene Name: HAUS augmin-like complex, subunit 6
  ENST ID: ENST00000415524
  CDS Start-End: 130-680
ttctcaagtggcatttactcatcgattccatcaatccatcaaatagttaacatccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaa

SEQ ID NO: 139640 - DNA, 1593 bp, Homo sapiens
  Payload ID: 7384
  Gene Symbol: HAUS7
  Gene Name: HAUS augmin-like complex, subunit 7
  ENST ID: ENST00000370210
  CDS Start-End: 732-1115
atgcgcctgggacttgcaatgatgaaacagggccattggcaaagctggggtaccagtcacccagccacgctctagggtggtagccaagaagacggaccccgagcgggaggcagagagacaagaggtggatgaagcagagcaagcgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggtgtccgccccgcctccttcccggtgtccgccccgcccccttccctgtgtccgccccgcccccttccctgtgtccgccctgcccgcttcactgtggtcctgcctctgggtggtgccggggcggggggtgggagcccggggcccgcgcaggcggagatgtcgcccaatgggaagggtcggtcgggaagggggtgggcgcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagagatttattcacgtgaccaatggcctatgacacagccccaggaggtcctgagaacatgtgcacaaggtggttgggctacagctggttttctacgatttagggagacataagacgtcagtgaatccatgtgagatgtacactggctggttgaacacgtgttttccatcctcttgggtgtatagctgggagtggaattgctgggtcacagggtcactctgtgcttaacttttcgaggagcccccaaactgttttccagtgcggcggcaccatcttccttttccagcagcagcgcgggagagctccagtttctcctcgtcctcgctggcacttgctggcatccgtcttgttgattctagccaccctgctcggtgtggggtggcatctcattatggttttgatttgcatttccccatgaccagtgatacggagcgtctttttgtgagcttgttggccatttctgtatatgctttggaaaaatttccatattcatgtcctttgcccacttttt

SEQ ID NO: 139641 - DNA, 1363 bp, Homo sapiens
  Payload ID: 7384
  Gene Symbol: HAUS7
  Gene Name: HAUS augmin-like complex, subunit 7
  Uniprot ID: Q99871
  ENST ID: ENST00000370211
  CDS Start-End: 45-1151
gctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaagc

SEQ ID NO: 139642 - DNA, 843 bp, Homo sapiens
  Payload ID: 7384
  Gene Symbol: HAUS7
  Gene Name: HAUS augmin-like complex, subunit 7
  ENST ID: ENST00000435662
  CDS Start-End: 1-635
ccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttct

SEQ ID NO: 139643 - DNA, 414 bp, Homo sapiens
  Payload ID: 7384
  Gene Symbol: HAUS7
  Gene Name: HAUS augmin-like complex, subunit 7
  ENST ID: ENST00000626181
  CDS Start-End: 31-414
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagagatttattcacgtgaccaatggcctatga

SEQ ID NO: 139644 - DNA, 1568 bp, Homo sapiens
  Payload ID: 7385
  Gene Symbol: HAUS8
  Gene Name: HAUS augmin-like complex, subunit 8
  Uniprot ID: Q9BT25
  ENST ID: ENST00000253669
  CDS Start-End: 192-1424
gcgagaccaagtgcgaggggaggacaggcgaagcgcgcgtctggggccgcgctctccacacttagccggcgctgcctcacgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagcagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattgaagcctccattttctatgaaggggccagttggaa

SEQ ID NO: 139645 - DNA, 1545 bp, Homo sapiens
  Payload ID: 7385
  Gene Symbol: HAUS8
  Gene Name: HAUS augmin-like complex, subunit 8
  Uniprot ID: Q9BT25
  ENST ID: ENST00000448593
  CDS Start-End: 204-1433
cgccgatggtgggcgagaccaagtgcgaggggaggacaggcgaagcgcgcgtctggggccgcgctctccacacttagccggcgctgcctcacgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattgaa

SEQ ID NO: 139646 - DNA, 3176 bp, Homo sapiens
  Payload ID: 7385
  Gene Symbol: HAUS8
  Gene Name: HAUS augmin-like complex, subunit 8
  Uniprot ID: Q9BT25
  ENST ID: ENST00000593360
  CDS Start-End: 2020-3069
gagttccgcgtcctcggctgggacgctgggcgacctccggcaagcggcctgaccgcccagtgcctcgctttcctccgctacgaaatggggccgatgacgcagctcaacctcgtaggcgtcgcgtgaggctgaaacgcgcttagatcggcgcctgggtctttactgtgatgtcgctcttggaattatcgttatgcagtgaacaagtgttgggcgaccaaagtgtcccctttaatcctcccacgcgctttattctgtgctcccagtttactgaggagatgatggagacccagggaggggaagtgacttgcctagggtaacacaccatgaacaagaaagaagttgaatactgaccgagagctaggcatgaatgatcatgaggctatatttgtctagttttgttaattctgccagtgttgattgtgccaggtgcaaactgaagtgaaattggccagcaagaggaatcactccaccgccccttgccgtaaccgatagattgacagtagcacctcccaggtacaggtgcagtagctgaggctcgcacaggttgtagggacccccctcaggtcgcagcaggttcacccaggagcccattcggtttgaggccacagccctagcacagtccccagagggagtctgtgctcttgtctctttctggctgtgagactgccccgggggtgacctatgtaaaacctgtgcgtctttgttttgcagcgacgaaaaagcaggtgtgaacagttaggaagctgtcgggttaggaggagcctacgggcgagcgcagctgctggcacctggcgaacatttgctaagttgcctctccccacggtggcctggaagtgtccccaacattgtctgggtctcactttggggtcctgggagcctgcttcagaggaggtggccgcagggaccagtggagccgcctttggtgatgggagcaggagttacagtgccctggccttggccctgcccctccacttgcccatccacttgcccctcctgtgttgctggtgtctgttcttggatcccttcttttctcaccagctcaggctgaaaccctgaaacccctagtcatcccagattctccctctcctgcacccccacagctgatgagtcagcgattcctatctcagggtcccttctttcctattacatcaggcttcattctatttttatttttatttttatttttatttatttatttattgagacggagtctcactgtcaccctggctggagtgcaatggcgtgatcttggctcactgcaacctgtgcctcccgggttcaagcagttctcctgtgtcagtctcctgagtaggagggactacaggcgcatgccaccaccccagctcatttttgtatttttagtagagatggggtttcaccatgttagccaggatggtctcgatctcctgacctcgtgatccgccagcctcagcctcccaaagtgaggtacctgctgggaccactcctcgtacctgcctgtcaagatgttgttcttccctttctgggaaggagctctgtgttttgttaccactgtgtctctactggaatatagtaggtgcatcaatgtctggtgaatgaatgaacccagggataatttgagatctgctgtgatctcttccacagagctctcattaccctcctctcttctcagtttgggtgttcacctatgccttcttgcccaggtgaccagggctggctgctccttgtgtcccttttcctgttgaggtggcccaccctcactgaaattgtcctctggcagcccttggactgggctgtctgagcttcaactagcagaggcacctcgccggcttccctgtgcttcttgggtagtgaggtgaacaagacctctctctcttctcttgcaggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagcagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaa

SEQ ID NO: 139647 - DNA, 1055 bp, Homo sapiens
  Payload ID: 7385
  Gene Symbol: HAUS8
  Gene Name: HAUS augmin-like complex, subunit 8
  ENST ID: ENST00000598517
  CDS Start-End: 1-120
atggcggattcctcggggcgaggcgctgggaagcctgcaaccggccccacaaattctagcagtgccaagaagaaggataaaagagttcaagtgtgtccccacaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagcagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatt

SEQ ID NO: 139648 - DNA, 826 bp, Homo sapiens
  Payload ID: 7385
  Gene Symbol: HAUS8
  Gene Name: HAUS augmin-like complex, subunit 8
  ENST ID: ENST00000601564
  CDS Start-End: 23-298
ccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaagcagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcg

SEQ ID NO: 139649 - DNA, 980 bp, Homo sapiens
  Payload ID: 7386
  Gene Symbol: HBS1L
  Gene Name: HBS1-like translational GTPase
  ENST ID: ENST00000314674
  CDS Start-End: 113-760
agccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggagtcttattttcttcttctgaagtttcagctgataatgttcaaagttcttatcctcagtcagcaaatcatttggattatagtagcaaaccctttgattttgctagctcagtaggaaaatacggattatctcataattcttcagttccaactcactgtttactccatagaaaaaagaaacttgacacacgtaaaagtgaaaagaaactagaatcatgaaaaccagtagattcccagacatcgcgaagtgaatctgaaattgtgccaaaagttgctaaaatgactgtatctggaaagaagcaaactatgggatttgaagtgcctgggtaagactttgagtacctccctcatccccacccccacccccaagtttttgaaatcactgttgcttctgtaagaaagagactgtttcaatttcgcataatatatcattagcact

SEQ ID NO: 139650 - DNA, 638 bp, Homo sapiens
  Payload ID: 7386
  Gene Symbol: HBS1L
  Gene Name: HBS1-like translational GTPase
  ENST ID: ENST00000367820
  CDS Start-End: 110-553
caagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggcccttgctgctagaccttcagcttttgcctcaacactgtgtcttcgttacccactgaaaagctgcaagcgacgcacccttgacctctataagactttt

SEQ ID NO: 139651 - DNA, 2793 bp, Homo sapiens
  Payload ID: 7386
  Gene Symbol: HBS1L
  Gene Name: HBS1-like translational GTPase
  Uniprot ID: Q9Y450
  ENST ID: ENST00000367822
  CDS Start-End: 194-2092
tgaccctgaggcattgccgtcgcgcggtgcacagctaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggagtcttattttcttcttctgaagtttcagctgataatgttcaaagttcttatcctcagtcagcaaatcatttggattatagtagcaaaccctttgattttgctagctcagtaggaaaatacggattatctcataattcttcagttccaactcactgtttactccatagaaaaaagaaacttgacacacgtaaaagtgaaaagaaactagaatcatgtaagttaacaaaagaactttcactagctaacctaattcatgatatgtcaagagattcctgtgaaagtcagccatcagtcagattatcatctacagacagtctggaaagtctgctttcaaagaacctagatgccgatttgttgagacctcatgcatctgaatgcatttccaaagatgattctgcattcaaagaaataccagatttaaagaccataatcataaagggcacaacaccgaataattctttatatattcaaaataattcactgtctgattttcaaaacattccagtacaggacagtttaggaagttcaaataatcctttgtacttaactagctcgttggaaaatatgactgttgataatttaaatgctagtaaagaaactgaagttggaaatgtttctttagttgaacaaagtgccaagaatcacacttttaaaaatgataatttgcagttttctcagtgtgaaagtccatccctaactgaactgtttcaggaacacaaagaaaacaatataagccagtgctttactttatctgacctttgtaaccagtcatctgccagtttcacagatctaagtttgggatcctttcccctgtcacaattagcaaatcgctgtcagtcttcacccggaatatcagaattaacaggatctctgtcgtcattggcatttcataaagcttctcccacaagagaccttgagaatttgtcactttctgaattgattgcagaaacaattgatgtagacaactctcagattaagaaagagtcctttgaggtcagtttatctgaagtgaggtctcctggaatagattcaaatattgatcttagtgtccttataaaaaacccagattttgttccaaagcctgtagtagacccatccattgctccatcatcacgaactaaagttctaagttcaaagctagggaagaattccaattttgctaaggataataagaaaaacaacaaaggctctctgactaggaaaccacctttttctctctcttggaccaaggcccttgctgctagaccttcagcttttgcctcaacactgtgtcttcgttacccactgaaaagctgcaagcgacgcacccttgacctctataagacttttctttatagtagacaagttcaagatgtaaaggacaaagaaataagtccacttgtagcaataacaccatttgacttcaaatcagcatcacctgatgacattgtaaaagctaatcaaaaaaaagcatttactagagaatagtaacaaaaggaaaacttgattgctgttgtagagctttttatttttaattaaagtcttcagaggatcactttatattatgggattcaaattctgatttttatgaaaattgtcgtaggtcagttgattagttgatacgtatttttgcactgattttttttttaactatgtcttctttcagtgataactggctttatttaagttggtaacctatactgagtatatgtttacaaagtggatatggaaacttgatgttgtgaaatcagacctcatatatttttgtttgaagcattcaactttctatgttttttataatgaaatatttttttctatgaaatatttttgtgctttgttcttaaacgaaaatgccagcacttgggattattatagtttagtgtgaagattattcttatgtggcacagcataactgagatgttatattttaaaatatgatataattcctagtttcattatttttctgtaaatactaaaatttttctattagaaaatcttaaaattcctgacttttgagagtactgtggagattgttgaaatacatttttgataataataaaatgaaaatcttttaagggaccatgtaaatatagaagttggattaatatgtgaattatttttatacatttttaaaaaccatttgtcctaagtatacactttaaaataaatatataaaaagtgttttcaag

SEQ ID NO: 139652 - DNA, 2703 bp, Homo sapiens
  Payload ID: 7386
  Gene Symbol: HBS1L
  Gene Name: HBS1-like translational GTPase
  Uniprot ID: Q9Y450
  ENST ID: ENST00000367826
  CDS Start-End: 129-2057
gcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcat

SEQ ID NO: 139653 - DNA, 7163 bp, Homo sapiens
  Payload ID: 7386
  Gene Symbol: HBS1L
  Gene Name: HBS1-like translational GTPase
  Uniprot ID: Q9Y450
  ENST ID: ENST00000367837
  CDS Start-End: 208-2262
agggaggcggacagtgaccctgaggcattgccgtcgcgcggtgcacagctaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgcaaaaaaaaaaaaaaaaaaagcaaagaaactaagtctgtacagcaaaagatggaaaggaaacaagaaaattaaatgaagacaaaggttgtgattattacagtaaatgaaaataggtttttatctttaaaatgtagactcaaactgcaaagctaatgatatgctatctgcaaaatattcctattttgtaaataaataaaaccatagatttaaagaagaaagggcacagatgtactggggagacaaaaataactgatccgttgggtgtataccatgtgccaagcaattttcatatactcatttaacatgacatatctataattatatgaggcagatattattaacctcagtctatagatgagaagactaaagctcagagggattgctaaaaactagtaaataaattatggaaccatgatttgaatttagatttaagtctgactgaggcatgttcagagacactacactgcctctccagaaatcaggagtagcaatattaacactggacaaagaatttaaagcaagtaaaaaaaaattaagagaatttcatattaataacaagtataatgcacaataaaactgtaccaaatgacataaaaatgcataatgaaatttattagaaattaaaaattaaagggcatagttacaattattgaggaattctcatagctctgccttatagatcatgtaaacaaacaaggtcatagaggacttaaatagcaaagcagaaaaaaa

SEQ ID NO: 139654 - DNA, 2636 bp, Homo sapiens
  Payload ID: 7386
  Gene Symbol: HBS1L
  Gene Name: HBS1-like translational GTPase
  ENST ID: ENST00000415177
  CDS Start-End: 129-1988
gcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataa

SEQ ID NO: 139655 - DNA, 629 bp, Homo sapiens
  Payload ID: 7386
  Gene Symbol: HBS1L
  Gene Name: HBS1-like translational GTPase
  ENST ID: ENST00000527507
  CDS Start-End: 202-629
ttttttttgagatagagtctctgtcacccaggctggagtgcagtggcgcaatctcggctcactgcaacctccgcctcctgggttcaagctgttctccggcctcagtctcccgaatatctgggattacaggctgagtgtggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtt

SEQ ID NO: 139656 - DNA, 544 bp, Homo sapiens
  Payload ID: 7386
  Gene Symbol: HBS1L
  Gene Name: HBS1-like translational GTPase
  ENST ID: ENST00000529882
  CDS Start-End: 42-544
agcagtctacagcaggcttcaggaagtgatgagggggggccatggaaagaccagccccttggacgctctgggtcactacgtcatggtggtacatctgggcacttaggtcctcagtgacctttctcccagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcg

SEQ ID NO: 139657 - DNA, 1600 bp, Homo sapiens
  Payload ID: 7386
  Gene Symbol: HBS1L
  Gene Name: HBS1-like translational GTPase
  ENST ID: ENST00000526100
  CDS Start-End: 1-224
ttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagct

SEQ ID NO: 139658 - DNA, 2102 bp, Homo sapiens
  Payload ID: 7386
  Gene Symbol: HBS1L
  Gene Name: HBS1-like translational GTPase
  ENST ID: ENST00000533274
  CDS Start-End: 1-1665
cagtctgtagaggatgattattgtatttcgccgtcaacaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagc

SEQ ID NO: 139659 - DNA, 551 bp, Homo sapiens
  Payload ID: 7386
  Gene Symbol: HBS1L
  Gene Name: HBS1-like translational GTPase
  ENST ID: ENST00000524715
  CDS Start-End: 127-551
agaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaa

SEQ ID NO: 139660 - DNA, 582 bp, Homo sapiens
  Payload ID: 7386
  Gene Symbol: HBS1L
  Gene Name: HBS1-like translational GTPase
  ENST ID: ENST00000525067
  CDS Start-End: 162-518
agctaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggtaaggagtcttattttcttcttctgaagtttcagctgataatgttcaaagttcttatcctcagtcagcaaatcatttggattatagtagcaaaccctttgattttgctagctcagtaggaaaatacggattatctcataattcttcagttccaactcactgtttactccatagaaaaaagaa

SEQ ID NO: 139661 - DNA, 2618 bp, Homo sapiens
  Payload ID: 7386
  Gene Symbol: HBS1L
  Gene Name: HBS1-like translational GTPase
  ENST ID: ENST00000527578
  CDS Start-End: 406-1968
tttttttttgagatagagtctctgtcacccaggctggagtgcagtggcgcaatctcggctcactgcaacctccgcctcctgggttcaagctgttctccggcctcagtctcccgaatatctgggattacaggtgcctgcaatcacatctggctaatttttttatttttagtagagatgggatcttgccactttacctatgctggtctcgaactcctgggctcaagtggtctacccgtctcggcctcccaaagtgctaggattacaggcctgagccaccccacccggcctgttcattattcttataatctgtttttttttttggattggcaataggctgagtgtggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataata

SEQ ID NO: 139662 - DNA, 633 bp, Homo sapiens
  Payload ID: 7386
  Gene Symbol: HBS1L
  Gene Name: HBS1-like translational GTPase
  ENST ID: ENST00000529169
  CDS Start-End: 1-512
aagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggtatttatctgcaagatgcttttgctaaacaagccttaagttgagacagcagatttttaaaaagtggtttagttacaactccaaagtaagtaacctcttactgaaattgtaactgactgtcaaaatgatactgactgttgaagattaaaatgtgaaaacattaaa

SEQ ID NO: 139663 - DNA, 881 bp, Homo sapiens
  Payload ID: 7386
  Gene Symbol: HBS1L
  Gene Name: HBS1-like translational GTPase
  ENST ID: ENST00000529641
  CDS Start-End: 153-881
gcagtggcgcaatctcggctcactgcaacctccgcctcctgggttcaagctgttctccggcctcagtctcccgaatatctgggattacaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaa

SEQ ID NO: 139664 - DNA, 2160 bp, Homo sapiens
  Payload ID: 7387
  Gene Symbol: HCK
  Gene Name: HCK proto-oncogene, Src family tyrosine kinase
  ENST ID: ENST00000262651
  CDS Start-End: 184-309
accacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggggcaaccgctgtcatgagttacagtccttccaggatgtgcctctgaaaatggattgcatataaatgatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtcttt

SEQ ID NO: 139665 - DNA, 2082 bp, Homo sapiens
  Payload ID: 7387
  Gene Symbol: HCK
  Gene Name: HCK proto-oncogene, Src family tyrosine kinase
  ENST ID: ENST00000375852
  CDS Start-End: 165-1745
ctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaa

SEQ ID NO: 139666 - DNA, 1806 bp, Homo sapiens
  Payload ID: 7387
  Gene Symbol: HCK
  Gene Name: HCK proto-oncogene, Src family tyrosine kinase
  ENST ID: ENST00000375862
  CDS Start-End: 229-1806
ctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggagggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 139667 - DNA, 1969 bp, Homo sapiens
  Payload ID: 7387
  Gene Symbol: HCK
  Gene Name: HCK proto-oncogene, Src family tyrosine kinase
  ENST ID: ENST00000486475
  CDS Start-End: 184-369
accacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccagacaaacaaagcaaaaccgctcaagtcttgaggtggcaaatctttcccagttcccaccagaagaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagt

SEQ ID NO: 139668 - DNA, 1742 bp, Homo sapiens
  Payload ID: 7387
  Gene Symbol: HCK
  Gene Name: HCK proto-oncogene, Src family tyrosine kinase
  Uniprot ID: P08631
  ENST ID: ENST00000518730
  CDS Start-End: 228-1742
ctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggagggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 139669 - DNA, 2101 bp, Homo sapiens
  Payload ID: 7387
  Gene Symbol: HCK
  Gene Name: HCK proto-oncogene, Src family tyrosine kinase
  Uniprot ID: P08631
  ENST ID: ENST00000520553
  CDS Start-End: 247-1764
accacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaa

SEQ ID NO: 139670 - DNA, 2215 bp, Homo sapiens
  Payload ID: 7387
  Gene Symbol: HCK
  Gene Name: HCK proto-oncogene, Src family tyrosine kinase
  Uniprot ID: P08631
  ENST ID: ENST00000538448
  CDS Start-End: 365-1882
ggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccagacaaacaaagcaaaaccgctcaagtcttgaggtggcaaatctttcccagttcccaccagaagaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttacc

SEQ ID NO: 139671 - DNA, 2151 bp, Homo sapiens
  Payload ID: 7387
  Gene Symbol: HCK
  Gene Name: HCK proto-oncogene, Src family tyrosine kinase
  ENST ID: ENST00000534862
  CDS Start-End: 238-1818
ggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttacc

SEQ ID NO: 139672 - DNA, 1969 bp, Homo sapiens; identical to SEQ ID NO: 139667
  Payload ID: 7387
  Gene Symbol: HCK
  Gene Name: HCK proto-oncogene, Src family tyrosine kinase
  Uniprot ID: P08631
  ENST ID: ENST00000629881
  CDS Start-End: 311-1828

SEQ ID NO: 139673 - DNA, 1227 bp, Homo sapiens
  Payload ID: 7388
  Gene Symbol: HAX1
  Gene Name: HCLS1 associated protein X-1
  Uniprot ID: O00165
  ENST ID: ENST00000328703
  CDS Start-End: 214-1053
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgctaa

SEQ ID NO: 139674 - DNA, 822 bp, Homo sapiens
  Payload ID: 7388
  Gene Symbol: HAX1
  Gene Name: HCLS1 associated protein X-1
  ENST ID: ENST00000435087
  CDS Start-End: 57-822
ccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctaaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgtttcttcctgtacacttgtctccttttttcctttggactctttctctcctgcttcttcatctctctgctcttccagatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtg

SEQ ID NO: 139675 - DNA, 842 bp, Homo sapiens
  Payload ID: 7388
  Gene Symbol: HAX1
  Gene Name: HCLS1 associated protein X-1
  Uniprot ID: O00165
  ENST ID: ENST00000447768
  CDS Start-End: 105-680
gcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctaaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcc

SEQ ID NO: 139676 - DNA, 914 bp, Homo sapiens
  Payload ID: 7388
  Gene Symbol: HAX1
  Gene Name: HCLS1 associated protein X-1
  Uniprot ID: O00165
  ENST ID: ENST00000457918
  CDS Start-End: 136-831
agtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccac

SEQ ID NO: 139677 - DNA, 771 bp, Homo sapiens
  Payload ID: 7388
  Gene Symbol: HAX1
  Gene Name: HCLS1 associated protein X-1
  ENST ID: ENST00000532105
  CDS Start-End: 178-633
ccccgtctgcgaatggaccactggaggggttcaaaggttcgcgtcccagtacgggaatgagcctctttgatctcttccggggctttttcggctttcctggacctcggagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactc

SEQ ID NO: 139678 - DNA, 1151 bp, Homo sapiens
  Payload ID: 7388
  Gene Symbol: HAX1
  Gene Name: HCLS1 associated protein X-1
  Uniprot ID: O00165
  ENST ID: ENST00000483970
  CDS Start-End: 116-979
gctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 139679 - DNA, 2370 bp, Homo sapiens
  Payload ID: 7389
  Gene Symbol: HS1BP3
  Gene Name: HCLS1 binding protein 3
  Uniprot ID: Q53T59
  ENST ID: ENST00000304031
  CDS Start-End: 27-1205
ccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccgtggaccccctgaagctatttgatgatcctgacctcggcggggccatccccctgggtgactccctcctgctgccagccgcctgtgagagtggagggcccacacccagcctcagccacagggacgcctccaaggaactgttcagagttgaagaggacttggaccagattctgaacctgggagctgagcccaaacccaagccccagcttaagcccaagccaccagtggcagctaagccggtgatacccagaaaaccagctgttccccccaaagcgggcccggctgaagctgtggctgggcagcagaagccgcaggagcagatccaagccatggacgagatggacatcttgcagtacatccaggaccacgatacaccagcccaggccgcccccagcctcttctgacccttccatgctggcccctggcccagcaggcctgtctgtggggacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagaagcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccggtatcctccccttcccctaccctaagctgtagcctgggtgactgactggcctgggcctggggtggggacgtccccaagccaaattactccagggcctctgctcctcgtggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttccccctttcccaggaaaggccagcccagtccatggccttcttgggcctctgggcacagagccaatgttcgtcattgcagctctcagcaaactgggtcatagctttccccacagctcagcctggggcctgggcagggctcccagcctgcaccgcctcccactgccagtggggcatgattctctcaggcttctgccccgaggccttcgtcgtcctcagggtctggacttggtcagtggcctttcaccagtggagctgccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaa

SEQ ID NO: 139680 - DNA, 4358 bp, Homo sapiens
  Payload ID: 7389
  Gene Symbol: HS1BP3
  Gene Name: HCLS1 binding protein 3
  ENST ID: ENST00000402541
  CDS Start-End: 16-657
gtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcggttggtctcctgttgttgagagggcccctttggtgtattccaggctttctggagatgacgtcccccttccctggaatctgagaaaagccctgagcatcccaggtcgccccctcgcagggatctgggccacgaggccttggcctggtgtgttgggggaagtagctctctgcgtgcccttggtggtgtgcatgtctctgggactgggcttaggtgtcgcctcccttctcgggtcacaggatgtcctccacttgtggctccgcactggggcttggtagagtcctccgtgacagctcagtagtgcaggctgcgggcctgtccggctagtgtgggaggactgggtgctccttccagctgtgggactcgcagaggtggctgcggctctctgggctgcatcatctgcatagcaggagcattcaccttggccctgcctccacacagggccattcaccagccatacatctctggccatttacaatctcttttcttcggttttcctcagtgaaaatggactcatggtcgtatcaacctcttagggctcctgtgacgatgaactgagttatgtaaatttagcaatcagctaccatcatggccccatctttcagtggaatcagaccaggccaggggtgctgtcctccccgctctctaccacaacgaatgtctcttagccgtttaccaaagccctcgggcgccagatgagtgtaggtcctgccgcagaaaggaattagagcccagtagaaattaggcagaagcaagttcaacttcatcagcatgtagaattctctcctaaaatcacagcccactctggaaaggccttcttcgtggggagggttatgggagggtgggctgcagggtggccatgagaccagcgtccaggggtgaggatttgcactgggaaagggtacgcggcgctcagggagctgcagcagaaacaggcctgagatctggggtcctgcggcacctgggcacagcaagtgccctgcagtcgctcctcctggccctccgtggctggccttgtccctgagtggggtcagcggccctgagggagaggcagccagagtagtgggtgatatggggacaagcctgtaatagtcactccttatcagcctggcccaacgcggcaggcctttcttgggctttattttggtaagggtgaggctttgtttgaactcacattctctgttgttctgagtaaccacacgtagtgccaaaccgagatggactttggtggtctgtgccaacctttggctgaagaacacacttagccgagcggctccttttttgggtaggaaaatgttctttgtggctggcaagtgctgccttgaacttcctacttacttcattagcagattgtcaggggagatgtgtcagctatcctgggaccccttggcggggcggggggggcgggggcagccccctccccagctctgtactctggggccctcacccctgaatcctgggaaagcttagcacctaagagtaatcctgccggcttaagaccctcccctgctggggtttctttttaaggacccgtgtgacaaggtgctgatgaatcaacgttatcacctctgtcaggaataataagtaaattttttgagagtttatgaaatgctgggaactaagttagcatttgcttgcatgatctcattatatctgtaagacagcatttctgaaactacttgctacaacccatagtaaaaactatatggtacgccatgacccaggacacacatgtataaacatcccataaaactgaagcaaaagttcccagaactcatacaaaaccttactaagtgtattgtactgggatattttctattctatttcaacgtttggaaaggtcatgactcgccaaactgctttcaggatccactgtgggcacaggtcaagaaacggagccctggaggcctgcactggcatcagcctcttctgtgtggtgggaaactcaagttcagggtcaggtggttcgtccacgttcctgcagcctgcagatggcagagccaggaccccacgccatctccagtccagtctttatcagcctgggaggtgggcagggccccaggattatccccctttcacagatggtaaaatcgaggaaggagttgagcaggatcttggccagagccgtgtgtgttccagagctgtgtgtgtggcagagccgtaccttgaagttgggtttccacctcggcctttcacagacacccaggtgggcttgttgatctctcttggtgccacccacctgccctttggtgggggactttctgttcttctcgggaggctgtttgtgcacccctctccctcccgtgcgcttggttcctgtgcagatgcagcggcacccgtttcccagcttgccctgccccatgtctgggcttagctctgggctctcctggagcggccaccatttccatgcaaccagcctcggtccttccccgccgtggccgcggcgaggcgctgctgctctgctgaagggctgctccacggcagggctgctgggagggtgggagtcgccagcacaaagccggagcccaggccggcctggcttttctttgtcttttaaacctggttttgattagggacaagagagcgttattacaccattagagagcaattaaagatagaaaaagccctcacctcggcccatcccaacaccaccgctctctccatctgctggggctctcttctgaccccgtcccagcagcatccatgcaaccgcaggcacaatgcacgtgccttttcgtactctgcttttccaccctatggtctgtcccgattgctgctccatgtcgcccctgttttgtatttaagtttctattttagaatgtcacggtgctgagaaaattgacattctaccctaatagttctgccttatgctggaaatcctctgcgggaaacctttttcattgtgactcaaataacacacaattagtatagaaaaattgcaaacacagataaaagtcctttccctgtgaatttctgaatgcacctttgaatattcacatcttactgccaaaatgagattgtcttgtgtgccgttctggaatttgcttttttccagcttacatgttctaggtccttccagatcaatagctgcactctccctccttcctctgctggtttctcagctcgatgggctgtaagtggcattaccaggcccttgcttgtgggcgtggcggggttttctgtaggtttttgctattacaggcaataacctgaggaacttctacatatacaaagcttttattctatggagccttcccctatatacgtgccccagagcaaggtccctgaagctgcttctgggggctttggggtaccattccagtaaaaggttctctaagggctgaagcccctctgttgggaggcccctctgcttttctaagccctgcccacccccgccctcagggcccactcctcccacctcttcttttgcacacagggaccccctccaggccctgggtccctgaggactcacagcgtccttgggacaggctggctcctgtatgaacaaatgcacctgcctgcaaagctggtcttcccagactccctggaagggggagcccacacccgggtccccgtgctgtggcctccgtggtgaagctggatgtttctctggaatgccacgttttatggttgttttttaatatggattttgcttcatctttcataaaacaaccacatgtattttagtataaaaataatatcttactctatatttggatgaaa

SEQ ID NO: 139681 - DNA, 1375 bp, Homo sapiens
  Payload ID: 7389
  Gene Symbol: HS1BP3
  Gene Name: HCLS1 binding protein 3
  ENST ID: ENST00000406618
  CDS Start-End: 22-621
cccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtacccaaggctctgccccatgtccctcaggtctccccggcccagaactaggccccgctgccgtgccccagtgggagcatgtccacagctgcctctgcagcctggaggcttcagccaggctggtgaggcaggtggcctcgctgacatccttggctggatggtgggcagaaggaggcctacccttgagggactgaacgtctggctgtcaggtgggggctcacacagcaggcattctccatagtgtgaccccatccatggccttcctggccagccccattcctagagcttgcccgacaccccccgactgaccatgcaccacatacaaccccctgacacacaccccacactcccctctgcctcctccaaccagccctagggacctgcagtatcccgggaaagctgtgttctcacagcctggctggtgacctgcccctggggacatgtgcttctcacctgtgcccccacagagagggtcatggggacagctccgggctgaggaattgatccagcacccctgcccccagtggtggagacgtcaagcccttcccatgggtgtcctggccctgtcttctctcctcagttttctcatctgtaaggtgggagtagcctggctgataggccgttatgagaatttacagagctaacacatgcaaagtccttagaacagaaacaaccacagtaaatagtggctacaattttaccccactcctcggttagtcctgtcaacccagaacccccgtggggcaggccctggtctcacagatgcccccaggacaaggcaggttctcaccactgctggtgccggactcccaccccttctcccctctttacatccgtctgcttaactccttcccagctactgtggatctcctagttccacaagacagaagggaagttttcaaaagaaagttgaccgtaaataaaacaaattatttaaagtgaaaggtg

SEQ ID NO: 139682 - DNA, 414 bp, Homo sapiens
  Payload ID: 7389
  Gene Symbol: HS1BP3
  Gene Name: HCLS1 binding protein 3
  ENST ID: ENST00000415264
  CDS Start-End: 1-224
tgtctccacaggacccctcggaggacgtgtcatccgtggaccccctgaagctatttgatgatcctgacctcggcggggccatccccctgggtgactccctcctgctgccagccgcctgtgagagtggagggcccacacccagcctcagccacagggacgcctccaaggaactgttcaggtgggaccatctagttgcaggcaaacaagctcagggctcccactgattctacattatggtgtttctgtaagagacacacagtggagaagagaaggccacgtgaaggctgaggcagggatgggcgtggtgctgccaccagcgggggaacgccaggaactggaagaggcaaagaaggaccctctgagggcgcagggtcctgctgacacctcaacttcagacttctggcctccagggct

SEQ ID NO: 139683 - DNA, 841 bp, Homo sapiens
  Payload ID: 7389
  Gene Symbol: HS1BP3
  Gene Name: HCLS1 binding protein 3
  ENST ID: ENST00000446825
  CDS Start-End: 472-841
cggagtccccgccgccgtcatgcagtccccggcggtgctcgtcacctccaggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccgtggaccccctgaagctatttgatgatcctgacctcggcggggccatccccctgggtgactccctcctgctgccagccgcctgtgagagtggagggcccacacccagcctcagccacagggacgcctccaaggaactgttcaggacactggctcataagggatttcaatgtgcacagagcaactgcctcctcacctccccacggattccac

SEQ ID NO: 139684 - DNA, 518 bp, Homo sapiens
  Payload ID: 7389
  Gene Symbol: HS1BP3
  Gene Name: HCLS1 binding protein 3
  ENST ID: ENST00000458740
  CDS Start-End: 1-399
cccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccgtggaccccctgaagctatttgatgatcctgacctcggcggggccatccccctgggtgactccctcctgctgccagccgcctgtgagagtggagggcccacacccagcctcagccacagggacgcctccaaggaactgttcagacaaattcaaaaagagccgtaacactgggattagcttcttgagagcaggaaccacattcattctttgtgtctgccctgtgactatccagggagtagttggacttcctcataataaagaatgttctgatagccattcattca

SEQ ID NO: 139685 - DNA, 2005 bp, Homo sapiens
  Payload ID: 7389
  Gene Symbol: HS1BP3
  Gene Name: HCLS1 binding protein 3
  ENST ID: ENST00000445102
  CDS Start-End: 1-334
ctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccgtggaccccctgaagctatttgatgatcctgacctcggcggggccatccccctgggtgactccctcctgctgccagccgcctgtgagagtggagggcccacacccagcctcagccacagggacgcctccaaggaactgttcaggtaccacctgtccccagcggcgcttggccagctctgagagtgttctggacagagccaagggcccggctcattgcccagtctcagccccagcctcctctgaggggaggaccccaggcctgtgaaaagtagaagcctgtgggtgcacattgggtgagaggcggtgaagggggctgagggggaggatccgcagcccagggctgctcagctagttccagaaagagagaactttgtgtgcacaaccagtctttcttttcacaatcatattttaacagtttatgtaaagaataattaaattatataattgcaagagcaggtataactggcataagcaagtttgggaacaaattaaacggactcatggcagcatgcagcccacccagcgagggggcaaagtgcagatgtcttggtgatggcctctctgccggagggcccggtcggcagctttcacagaaggaagggagaatgaggcctcagctgtcacatggaggtcaattggcagaacctgtgccggtgacagctcctatttcctgagtccttgctgtgtacgcagtaagccagactccttacacgctctcttatgtaatcttcacgacagccccctaaggtggatgctattttctccatattataagaaatcaagtgtgggacgccacctggctaagacccctgctctgcccctggcctggcctctccacttcatcagggactgtctgagcacttggctgggtgatctgcctccccacccagccccccagttctccccaggcctttacctccactggccacattctcagcagactcagtgttgtgcgtgtctccagctcccactccatgctccaggacacaggactgtgcctgggattcagaggaagccaggccgcctctttccaggaacggcttatgtgacaccaaggcatgcaggccctggaggctgtcatctgtacccctcattagcagcctcgggctattagacagccctgcaagtgcccgccaagcctgagtcaccgtgacggcttctggtatttacatgtccccaaggcccctggcatctgttcactctcatcctgtgtcctcgctcctgacatcccagcgggctggaagaaaccaggattgttattttattagagggaaaccgaggcacagggaaatgaaatactagagtctgcctgcggagcagcagggccaggccgagcatgtctaggagtccatgtgtcccagtggggtggctctcgtgggacctttctggcctagtttattctaaatccgttacttcccaacctgtgttctgcagaacgtggtacagtggggtggtcaaaggctatcttcaaaggggctctgtggctgatgaattggggaaatgccacaaaaagcagggctcgtagtgcgcgggccagcaccacatggcacttcacgttctcattcatccctgggccccccactctgtggtgccccttagcatcccgcagagcgcttggggagtccctgctcaaaaagtgtgggtcccgcacccccaccttcactttagcagacatctgctaatgaaaggattaactgcttttcttttttttaaattcagacaaattcaaaaagagccgtaacactgggattagcttcttgagagcaggaaccacattcattctttgtgtctgccctgtgactatccagggagtagttggacttcctcataataaagaatgttctgatagcc

SEQ ID NO: 139686 - DNA, 78 bp, Homo sapiens
  Payload ID: 7389
  Gene Symbol: HS1BP3
  Gene Name: HCLS1 binding protein 3
  ENST ID: ENST00000631166
  CDS Start-End: 1-78
atgcagtccccggcggtgctcgtcacctccaggtctccaaaaagtacagcgagattgaggagttttaccagaaactga

SEQ ID NO: 139687 - DNA, 1350 bp, Homo sapiens
  Payload ID: 7390
  Gene Symbol: HDDC2
  Gene Name: HD domain containing 2
  Uniprot ID: Q7Z4H3
  ENST ID: ENST00000318787
  CDS Start-End: 43-258
cttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatgtatcatcaggtgagaaatataaataggaactggggtcattgagcctcaggtagggaatatatcaacccgatttcttcctctcttttcccttttataggataaataatcc

SEQ ID NO: 139688 - DNA, 918 bp, Homo sapiens
  Payload ID: 7390
  Gene Symbol: HDDC2
  Gene Name: HD domain containing 2
  Uniprot ID: Q7Z4H3
  ENST ID: ENST00000398153
  CDS Start-End: 44-658
gcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacct

SEQ ID NO: 139689 - DNA, 564 bp, Homo sapiens
  Payload ID: 7390
  Gene Symbol: HDDC2
  Gene Name: HD domain containing 2
  Uniprot ID: Q7Z4H3
  ENST ID: ENST00000609477
  CDS Start-End: 27-242
tccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcagctacaggagcggaatcaggagtttccaatgtgaagcttctaactcaagagaacaactgaagctttcaggcctggggcagagagctgtgctcatgtgcccctggaagtcacgacgctacctttgg

SEQ ID NO: 139690 - DNA, 538 bp, Homo sapiens
  Payload ID: 7390
  Gene Symbol: HDDC2
  Gene Name: HD domain containing 2
  ENST ID: ENST00000608284
  CDS Start-End: 147-470
aggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagagaaaaggaagacataagaaactccattttgatctgtacacctgtagactaacgggctcagtagccagcaggatttttgcccttc

SEQ ID NO: 139691 - DNA, 879 bp, Homo sapiens
  Payload ID: 7390
  Gene Symbol: HDDC2
  Gene Name: HD domain containing 2
  ENST ID: ENST00000608295
  CDS Start-End: 6-332
gccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggtcagtgttgactattgactgtgcaaaaaaccaccagaaaaacctcttgctgaagcaaagctaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaa

SEQ ID NO: 139692 - DNA, 1047 bp, Homo sapiens
  Payload ID: 7391
  Gene Symbol: HDDC3
  Gene Name: HD domain containing 3
  Uniprot ID: Q8N4P3
  ENST ID: ENST00000330334
  CDS Start-End: 7-429
cgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagaggtaaaaatacaatagctgggccaaggggaagttttcaggacagctcattccatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaa

SEQ ID NO: 139693 - DNA, 1880 bp, Homo sapiens
  Payload ID: 7391
  Gene Symbol: HDDC3
  Gene Name: HD domain containing 3
  Uniprot ID: Q8N4P3
  ENST ID: ENST00000394272
  CDS Start-End: 30-569
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggtttaagctgctgctgctccttctccagcctccgactggtgggctgcatatctttccttcagcaaagcaggactaattgtgtgtcccggagtcacctccctcaggttgcgggcctcaacccctccgaacctggcttccttgtcagtgacatgggttgtgtaattatcaggttagactgtgacgtgcctgatggagcctgacacataggtgctcaagaaatggtagcagcctttcccgttaagaaagttggaagggggccaggcgcggtgtctctcgcctgtaatcccagcactctgggagaccgaggcgggcggatcacttgaggtcaggagttcaagaccagcctggccagcatggcgaggccccgtctctactaaaaatacaaaaaaaaattagccgggcgcagtggctcgcgcctgtaatcccagctactcaggaggctgaggcaggagactcgcttgaacccgggaggcggagtttgtactgagccgagatcgcgccactgcactccagcttgggtgacacagcgagactccgtctcaaaaatgaaaaaagaaaagacgtatcggaagggagtgccgcccgcttactgacaaccactgctgggcaccggagagaccccagcagcaacatgattgggccggtgggggattccggttccccagtacctcaagccgcgcgggaaactcggtgactcgcaatcccctcgcccttccgcattgcgggttacttcggttgttaagtgacagggacttccgggaaggcccggaagtggcccggggctgtccgaccccgggagcccggcggtcggcgtaggggaggcggtggaactttgctcggtggccatggggagggattgcccggtggtggtttttcagtcgttgctgagcagctgaggtttatttttatgtattttattctgcatccagtcatccattaaagccaaagtttattaagttg

SEQ ID NO: 139694 - DNA, 457 bp, Homo sapiens
  Payload ID: 7391
  Gene Symbol: HDDC3
  Gene Name: HD domain containing 3
  ENST ID: ENST00000561036
  CDS Start-End: 1-457
agcggcggaaggaccccgaggggaccccctacatcaaccaccccatcggtgggcgcgtcggccgcggagcgccggctgcggcacctgggtggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggatggtcagaacatcgagtccaggaatacttcgagtgggcagcgcaggtggtgaaggggcttcagggaa

SEQ ID NO: 139695 - DNA, 1024 bp, Homo sapiens
  Payload ID: 7391
  Gene Symbol: HDDC3
  Gene Name: HD domain containing 3
  ENST ID: ENST00000559898
  CDS Start-End: 11-442
catccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggtacgctttcgtatgggctgtaagggaaaagggagggggatgccgccttctgaagacacatgttggtcagttcccctgaaaaaccctgggcattcttaattcccaaattaatcctactggaccactctttgatcttctttcatacagtaaaaatacaatagctgggccaaggggaagttttcaggacagctcattccatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccc

SEQ ID NO: 139696 - DNA, 5614 bp, Homo sapiens
  Payload ID: 7392
  Gene Symbol: HECA
  Gene Name: hdc homolog, cell cycle regulator
  Uniprot ID: Q9UBI9
  ENST ID: ENST00000367658
  CDS Start-End: 286-1917
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacgaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtataaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgtgcctggccaagtttcagttctatatgaagtatttgatgttttgtttgaaacaatacagcattaaagaaccaatgttattcactaatatcattcatctttcagtttggatgatttggtttgctgcatctaggttggtgtttgatcatctgaaaaaacatttcagtgggaagaaatgcataaaatgcctataagaagtagaaagtcattgaactgacagtgtttgatgcaactaaaagaggattgtaagacatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaaggtattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaa

SEQ ID NO: 139697 - DNA, 1738 bp, Homo sapiens
  Payload ID: 7393
  Gene Symbol: HAND1
  Gene Name: heart and neural crest derivatives expressed 1
  Uniprot ID: O96004
  ENST ID: ENST00000231121
  CDS Start-End: 257-904
gcggtcttatataagccagatccgcaggggagtccgcagaagggttaaacaggtctttgggcttcggcgacctcgcccgcggcagaaaccggtaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaaaggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaaaggctcaggacccaagaaggagcggagacgcactgagagcattaacagcgcattcgcggagttgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggcggatggcggccgtgagagcaagcggaaaagggagctgcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgattttttttaatacattaagagaaagagaaatatatatatatccacccccagcccaaccgagggcggcccttggcggcaacatgcaagaaggagggactgtcgaacccaagggctcaaagacgcactcttccacccttttggagcgaatttagaacctcagccctatctccatttccctatctggctctttctctcttgtccctccatatgatccgccccgacgccgtcttctctaattaaaatgcaataaggaatcaattcttttctgcctgagaaagagaaccagacgcaggaagatgaaaggctgccctttgttcttcgaatcgtggtggttttattttatttttctttttgtcgctgcacttcctgtttagttccaagggaaacactttctctctttctctgtctctctcttttcttccttcttttccttcctttttgtttctatctaaataaaagctttccctgtgttggaaagtttttatgtatttaaactacctaccatgcctgttgtgctcaggtgtttgttcatcctgccatccccaacccttttctacctcaagtctgtgtgaccactcacagcccccctcccttcgccaaagcagtgtctatgctcttgattaataaaacattttctgaaatca

SEQ ID NO: 139698 - DNA, 2780 bp, Homo sapiens
  Payload ID: 7394
  Gene Symbol: HAND2
  Gene Name: heart and neural crest derivatives expressed 2
  Uniprot ID: P61296
  ENST ID: ENST00000359562
  CDS Start-End: 941-1594
agctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgccaggaccagctcgccgcgccccatggggagccggcggccgcagcgctgctgaggcgggcccggctggccaggcggggggacggggcccgggctgcagcagccccctctgcggctgccgggcgggcccgggcgcccgggggctggggggtggggggtgggggaggacgccgagcgctgaggcaggggcccgggccgagggcgcggcggggctgcgcgcacgctggggcgcgtggaggggcgcggagggcgaaatgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatgattgcctctaactttattttaaagactcagtggttccaaccagtcaccctgacctgcggcctacgcaggaggaggaggtgctcttaaagagaagtgtccttgttacaaatcctgcaaatggtctggggtttgtcggtgtggtgtctccttccctcttcccccagctggagaacgctgagtagtctctagaaggaagatctgggctggagaacccagtccggcagttcgctcagaaggtgtaaaggtgctcttgctttcctgaagtcaatcagaagccatttcttgaggccgtcagtttttgtttggagagtgtttctggtggaggagttgtgaggagaaccccggcattattgctgcaacgggaactagtctggggtgtttaattcaaactatggggctttcatccaagaa

SEQ ID NO: 139699 - DNA, 706 bp, Homo sapiens
  Payload ID: 7394
  Gene Symbol: HAND2
  Gene Name: heart and neural crest derivatives expressed 2
  ENST ID: ENST00000503024
  CDS Start-End: 1-277
ccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtgcaggccgaatcagacccggcgtgggcgaattcagaagtgcccagggagagacaagctagaggctctgcggacttctgcgggcggctgacaacgcgagggcgaggggagaaagccatcaggtcctagacgtggaagaaaggagcctaccaaagtgttggagtaaac

SEQ ID NO: 139700 - DNA, 1337 bp, Homo sapiens
  Payload ID: 7394
  Gene Symbol: HAND2
  Gene Name: heart and neural crest derivatives expressed 2
  ENST ID: ENST00000621866
  CDS Start-End: 1-561
atgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatga

SEQ ID NO: 139701 - DNA, 9156 bp, Homo sapiens
  Payload ID: 7395
  Gene Symbol: HEG1
  Gene Name: heart development protein with EGF-like domains 1
  Uniprot ID: Q9ULI3
  ENST ID: ENST00000311127
  CDS Start-End: 69-4214
ccgctgcccgctgcccgctgccctcgccccgcgcgccgggcatgtgagcgcgggcgggcgccgtcaccatggcctcgccgcgcgcctcgcggtggccgccgccgctcctgctgctgttgctgccgctgctgctgctgccgccggcggcccccgggacgcgggacccgccgccttccccggctcgccgcgcgctgagcctggcgcccctcgcgggagcggggctggagctgcagctggagcgccgcccggagcgcgagccgccgcccacgccgccccgggagcgccgcgggcccgcgacccccggccccagctacagggcccctgagccaggcgccgcgacacagcggggaccctccggccgggcccccagaggcgggagcgcggatgctgcctggaaacattggccagaaagtaacactgaggcccatgtagaaaacatcaccttctatcagaatcaagaggacttttcaacagtgtcctccaaagagggcgtgatggttcagacctctgggaagagccatgctgcttcggatgctccagaaaacctcactctactcgctgaaacagcagatgctagaggaaggagcggctcttcaagtagaacaaacttcaccattttgcctgttgggtactcactggagatagcaacagctctgacttcccagagtggcaacttagcctcagaaagtcttcacctgccatccagcagttcagagttcgatgaaagaattgccgcttttcaaacaaagagtggaacagcctcggagatgggaacagagagggcgatggggctgtcagaagaatggactgtgcacagccaagaggccaccacttcggcttggagcccgtcctttcttcctgctttggagatgggagagctgaccacgccttctaggaagagaaattcctcaggaccagatctctcctggctgcatttctacaggacagcagcttcctctcctctcttagacctttcctcatcttctgaaagtacagagaagcttaacaactccactggcctccagagctcctcagtcagtcaaacaaagacaatgcatgttgccaccgtgttcactgatggtggcccgagaacgctgcgatctttgacggtcagtctgggacctgtgagcaagacagaaggcttccccaaggactccagaattgccacgacttcatcctcagtccttctttcaccctctgcagtggaatcgagaagaaacagtagagtaactgggaatccaggggatgaggaattcattgaaccatccacagaaaatgaatttggacttacgtctttgcgttggcaaaatgattccccaacctttggagaacatcagcttgccagcagctctgaggtgcaaaatggaagtcccatgtctcagactgagactgtgtctaggtcagtcgcacccatgagaggtggagagatcactgcacactggctcttgaccaacagcacaacatctgcagatgtgacaggaagctctgcttcatatcctgaaggtgtgaatgcttcagtgttgacccagttctcagactctactgtacagtctggaggaagtcacacagcattgggagataggagttattcagagtcttcatctacatcttcctcggaaagcttgaattcatcagcaccacgtggagaacgttcgatcgctgggattagctacggtcaagtgcgtggcacagctattgaacaaaggacttccagcgaccacacagaccacacctacctgtcatctactttcaccaaaggagaacgggcgttactgtccattacagataacagttcatcctcagacattgtggagagctcaacttcttatattaaaatctcaaactcttcacattcagagtattcctccttttttcatgctcagactgagagaagtaacatctcatcctatgacggggaatatgctcagccttctactgagtcgccagttctgcatacatccaaccttccgtcctacacacccaccattaatatgccgaacacttcggttgttctggacactgatgctgagtttgttagtgactcctcctcctcctcttcctcctcctcctcttcttcttcttcagggcctcctttgcctctgccctctgtgtcacaatcccaccatttattttcatcaattttaccatcaaccagggcctctgtgcatctactaaagtctacctctgatgcatccacaccatggtcttcctcaccatcacctttaccagtatccttaacgacatctacatctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacagtgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccatgtgcaacaatactcagggatcctttatctgcaaatgcccggttgggtaccagttggaaaaagggatatgcaatttggttagaaccttcgtgacagagtttaaattaaagagaacttttcttaatacaactgtggaaaaacattcagacctacaagaagttgaaaatgagatcaccaaaacgttaaatatgtgtttttcagcgttacctagttacatccgatctacagttcacgcctctagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactcgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttacattgcacttatccatgagataaataaaaggagaactgtttttatcagtggaggctaacctaaaatttcaaagtgtcgcctttttgaaatcttgggcctctctctctgtagaaccaatggccctttgtggctcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtctgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaaaaaaaaaatgctgactacccttttgaaaatgtgctttcagattgttttttatatgtaattcttagacacttgtcattaagaaaatagtggctggcttgtgctcagcaagaagcacactggcacgtggctttggtataggaagtggaaggcaaggacctgggtttctgacaagtgcagtcagacatacacatccatctgagagctgcttgccttgttcccgtggtaaggccatggctcccacatactggaagcatatttttgtgaactgttttcagaattgggaacatattcagtggaatgtcttaaacgctgacacatcttcctcctttgaggggaagtatattttcagaagcagctaagacatttagagccaaaattgctgataggtggttcagtcaagttggctgatggcatctgaggtcaaaaactaagatgtgacgattgagttcttaaagaggtaactcttaaagtgggcccaagggagaaggcagcatctttggactcctaggctggatggctacccaagaatatgccattgaaggatgacacctattcagatgtgaaagttcccagagcaggcacctttgggtcacccaccacgtgtggctttttggtgcctgcatgaaactgtgttgccccctggtgagatgcccgggtgtcctgtaagccgatttaactctgcctgaggaagaggagctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttttctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggagtcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttca

SEQ ID NO: 139702 - DNA, 532 bp, Homo sapiens
  Payload ID: 7395
  Gene Symbol: HEG1
  Gene Name: heart development protein with EGF-like domains 1
  ENST ID: ENST00000482699
  CDS Start-End: 1-192
agaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgggagcctttttttgagatccaactggtcacttgaggattgctgttggcctcctggtttggggtcctaactccacctgcaactagatggtcgtaggaccttataaagcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagcc

SEQ ID NO: 139703 - DNA, 3973 bp, Homo sapiens
  Payload ID: 7395
  Gene Symbol: HEG1
  Gene Name: heart development protein with EGF-like domains 1
  ENST ID: ENST00000487661
  CDS Start-End: 1-798
gcctatagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactcgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttacattgcacttatccatgagataaataaaaggagaactgtttttatcagtggaggctaacctaaaatttcaaagtgtcgcctttttgaaatcttgggcctctctctctgtagaaccaatggccctttgtggctcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtctgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgc

SEQ ID NO: 139704 - DNA, 793 bp, Homo sapiens
  Payload ID: 7396
  Gene Symbol: HEATR1
  Gene Name: HEAT repeat containing 1
  ENST ID: ENST00000366579
  CDS Start-End: 100-462
ggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggtagctaatagaattacagaaataactatgggttaatcactttggtcttgtaaaaaattaagtagttgagaacttatcaaattaaagctgaaaaattaggtatattaagagattgatacaatgtccattgtgtgagataagcatgctcttctgcctttaaattcttttttgttgatagtgaaaagtagaactactggtgattttgagtaaatggtctaacctcattagtttttttttgagatagagtcttgctgggcactcaggctggagtgcaatattgaaatcttggctcactgcaacctctgcctcccaggttcaagtgattctcccacctc

SEQ ID NO: 139705 - DNA, 6538 bp, Homo sapiens
  Payload ID: 7396
  Gene Symbol: HEATR1
  Gene Name: HEAT repeat containing 1
  ENST ID: ENST00000366581
  CDS Start-End: 116-6307
gagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggacgtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcattacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcagtttttagcagattctgatacttctttgatgctcagcctgaatcatccacttgctcctgtgagaattctggccatgaatcatttgaaaaagatcatgaaaacatcaaaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttatggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggtggaggatttaataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaataaagaagcttgaaagtgtcattactgcagtggaaatcccctcagaatggcacattgaactgatgttagacagagggatcccagtggagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtgcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactatctccagatggtggcaaaatacccaaagatattttagatgaggagaagttcaacgtggagttgatagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcagtgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcgttgtataccttaaagcttttatgcaagaattttggtgcagaaaatccagatccttttgtcccagtgctgaacactgctgtgaaactgattgctccagagagaaaggaggagaagaatgtcctgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaagccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgaaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagaagccttgatgatgcctctggtggatcagctggaaaacaggcttgggggagaagagaaattccaggaacgggtgacaaagcacctgataccatgcatcgcacagttttcggtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttctttacaaaatccccacctggcttgtgctgccacataagcctctcctgcctatcgtatagagctgcagaaagagtaaatgatacacggtattttt

SEQ ID NO: 139706 - DNA, 8447 bp, Homo sapiens
  Payload ID: 7396
  Gene Symbol: HEATR1
  Gene Name: HEAT repeat containing 1
  Uniprot ID: Q9H583
  ENST ID: ENST00000366582
  CDS Start-End: 116-6550
gagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggacgtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcattacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcagtttttagcagattctgatacttctttgatgctcagcctgaatcatccacttgctcctgtgagaattctggccatgaatcatttgaaaaagatcatgaaaacatcaaaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttatggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggtggaggatttaataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaataaagaagcttgaaagtgtcattactgcagtggaaatcccctcagaatggcacattgaactgatgttagacagagggatcccagtggagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtgcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactatctccagatggtggcaaaatacccaaagatattttagatgaggagaagttcaacgtggagttgatagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcagtgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcgttgtataccttaaagcttttatgcaagaattttggtgcagaaaatccagatccttttgtcccagtgctgaacactgctgtgaaactgattgctccagagagaaaggaggagaagaatgtcctgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaagccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgaaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagaagccttgatgatgcctctggtggatcagctggaaaacaggcttgggggagaagagaaattccaggaacgggtgacaaagcacctgataccatgcatcgcacagttttcggtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttctttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttacatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctggaatgctttttttaacccaggagtgtgactgtcacctttatcctttgttcttttgggaaacgggagagatgaaggcaacacgctgcttctaaaacagctcacacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagtttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcgatttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagaaaaatcacagaaatggaaccatttaacttgctgatacaggtttgattttaatcacgtaaagtggaagagtgctttgatctcagttgctaatgatgatggactaatctttagaagaacggaggccttgattggtgatttcatgggaacaaaacagatttctgcattacctctgcctgctttgtgggtcccttagttggcgtacactttctgatagtgcctgccttatgaatgcctgaagtctaatcctgaccttactttgttgcccataaatatctttcaaattgaa

SEQ ID NO: 139707 - DNA, 3560 bp, Homo sapiens
  Payload ID: 7397
  Gene Symbol: HEATR3
  Gene Name: HEAT repeat containing 3
  Uniprot ID: Q7Z4Q2
  ENST ID: ENST00000299192
  CDS Start-End: 192-2234
accccgccccgccccaaccccgacccggcagacgacgcgccgtgcgcctgcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagctccagcacccgagcgccgaggtccgcgagtgcgcctgcgcagggctggcccggctggtgcagcagcggccggcactcccgggcctggcgcgacgagacgccgtgcgccgcctcgggccgctgctgctagaccccagcctggccgtcagggagactgcagccggcgcgctgagaaatctcagtgcttgtggaggttttgaagtttgtgatgacatggtgactaaggatatcatgacccctctggttgcgctgctaaaagagtgtagtgctggactggattcaaatgagatgtctctgcaggagaaaaaagatcagaacagaaattctattgagaacatagccaatgagactgtgaacgtgctgtggaatatatgtgaatgcagtagtagagcagtgtctatattcaacaaagaagggtgtttggagattgtgttaaagtatttaagtaggtttcctaccaatgttgacctggctatttcagtagcatattgtttgcagacagtgactgaggataacccagagctgctgaagtctttcagtgctacagcattgaacatgctggaatcagcactgctttctcctgtcagttccatggaatctcttctattgaagacattggtagcaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccgcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtggctcacgcctataatcccagcaccttgggagaccgaggcgggtggatcacttgaggtcaggagtttgaggccagcctggccaacatggtgaaaccgcatgcataagcatggtggcacatgcctgtgatcccagctactcgggaggctgagggaggagagtcggttgaacctgggagacagaggttgcagtgagctgagatcacgctactgcactccagcctgggtgacagagggagaccctgtctccaaaaaaaaaaaaaaaaaaaaacttcaaaacctgtcagaaactctgttgctggtttttttgtgtgtgtgttttgtttgtttgttttgttttgttgtttttttcttttttgagatggagtctcactgctgcccaggctgtattacagtgctgcgatcttggcttactgcaacctctgccattccaggttcaagcgattctcatgcctcagcctcctgagtagctggaattacaggcacccaccaccacaccttgtttttgtttttggttttttggtttgtttttttttttcagtagagacgggtttcaccgtgttggccaggctggtctcaaattcctgacctcaagtgatccgcctgccctggcctcccaaagtgctgggattacaggcatgagccaccgtgcctggccagaaactcttttttaagtgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttctatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaa

SEQ ID NO: 139708 - DNA, 3469 bp, Homo sapiens
  Payload ID: 7398
  Gene Symbol: HEATR4
  Gene Name: HEAT repeat containing 4
  Uniprot ID: Q86WZ0
  ENST ID: ENST00000334988
  CDS Start-End: 270-3350
ggaacctaagaaaccaaggaaggcttaagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctggcttctgcctcctgagaaggaggccagagcgtgggaggccactgtgctggaaaagctgaacgagcgcacagcccgatggatccagagcaagcgtcctcgaaggcctggggcatcccccaacaagtggcagagcttcctgcgccagcagtacgactggagtcacattcgggatgagcttacctctgccagtgacctggagctcctgaaacagctggaggcagaagagacagcagagtttgaggatcaaagtgtcatcctgcccccacaggaaaagaagaagccagaactgctgcttcccgtttactacagattgcccagttacttccaacaagcagagacagttgagatcatgcctggcaacaagagcactgaggatatccatgaaaagacgagcctctcccagccccaaacccagagctactttcgccaggtgactccccgagctggaaagtttgcctactccacagacaacacctttgaacaggagatttactttgatgaagtccagatcatccaccagattggtgcaaagagagaccagattgtcctggaaaacctaaatcggtacaacaagcagctatctaaggtcttccctgaaactccagaaaagtggagtgcccaggcaattcctgaagcatcttacagacctgtgcaaggagccctgcgctggactgctttgcccacccccgccaaggatatgctgctgcaggtgggtgagaaggatgtgcctattaagaccaggagattgaagaagcaggcaaaatcactgcaggaggatgtgacctgggaactggtggtcctgcggaggatgctgaaggaatggaagactgcctgggctctgatcatagagtggcaccatgagacagtagagaacctgcttcagagcttgggagacctgcatgatgacgttcggatcaaagctatcaccacatgtgccacagctgctttggaacggccccggattgccaccagccagagagactcagacaagaccatccaggacttgccggaggttctactgcctgccctagaggctgctctttgtgacaagaatgcccatgtgcggatggcagcagcaatatgccaatatgccatacagtcacataatccccttgcccggaacatcatgcagactgcccttctgaagggtaacagtgtggatagctgggctgcagctcagtgcttggctctggaaggtactgctacttaccctgtgattaagaggatcctccaccagctgtttacaaagaagaatgaggacactgaggaacagtcttatatcctcctgagctatctgagtgagaagacaaccctgatacacaccatgcttgctgtggagctgaacagctgtcaatggaagaaccggattgtggcctgccaggctttctcccggatcagtggaaatgtctgcttggatatgaaacataagttgatccagctgatgtggaatgactggaataaggaagtgaggagagcagctgcacaggcgcttgggcaaatgagcctcgggaaagaggtgcacgacataatcagggtcaagctaggtcaaggaaattcccaggagcgtgtggaagctctctacctgataggtgagctcaagcttatgaccgccaagcttctcccaagcttcctgcactgcttctctgatgacttcacagcagttcggcgggcagcctgtttggcagctggtgccctgcagatccgcgacaagatggtgcttgaatgcctcctgaacctgatgcagagagatccttactggaaaatcaaggcctttgccattcgagctttgggacagattgggcaagtaagtcccgagctgacggatcttctgctctgggctatccactatgaagagtcaccaggtgtacggctggaagcttgccgtagcatcctagccctgaaacttcaaggggaccgggtcagggacaccttcctagacgtgctgctcctggagaaccacgatgctgttctaaaagaaatgtaccagacaatgaagatactcaacttaggaaatgaaggaaaccaagaaatgcttcaggagatcaagaacaggattaaaacactaagccaaaaggacttgctgacacacaaaatactcaagctggagatggtcatgggaaaagtgagggaggaagcaaaacgtgtttacttgaaacccaaaggagaacaaggaccactaacactccagactttactccaagaaacttttcaggatgagatggttcttcctagaagaccttccgaggtttgtgacactgaagcagtgataaagcctgtgaagccccgcgcaccaaatccctggttacaaagttcagtcccaggcctaaccacacgaagcaaagttcgttcatcacttgtcaaagatctacgcacctcccccgagaaaaggattgctgtgggaccatttagatccgactacccagctctttatctgggtaaattctcagagagaacatttttttctcccatcatgtcttctccctctggaaagaaaggtgctcatctctaagctgaacacttgtcttacttcaagatgcaggaagcagtggacctggtcacattgggtctttttaattgatactgtacaatcttgttgtcactatgtttataaagagaaattatttaaca

SEQ ID NO: 139709 - DNA, 3523 bp, Homo sapiens
  Payload ID: 7398
  Gene Symbol: HEATR4
  Gene Name: HEAT repeat containing 4
  Uniprot ID: Q86WZ0
  ENST ID: ENST00000553558
  CDS Start-End: 323-3403
aagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggcgcagtcccagcatttctggaggccaaggcaggaagatcgcttgattccaggagtttgaaaccagcctggacaacatagtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctggcttctgcctcctgagaaggaggccagagcgtgggaggccactgtgctggaaaagctgaacgagcgcacagcccgatggatccagagcaagcgtcctcgaaggcctggggcatcccccaacaagtggcagagcttcctgcgccagcagtacgactggagtcacattcgggatgagcttacctctgccagtgacctggagctcctgaaacagctggaggcagaagagacagcagagtttgaggatcaaagtgtcatcctgcccccacaggaaaagaagaagccagaactgctgcttcccgtttactacagattgcccagttacttccaacaagcagagacagttgagatcatgcctggcaacaagagcactgaggatatccatgaaaagacgagcctctcccagccccaaacccagagctactttcgccaggtgactccccgagctggaaagtttgcctactccacagacaacacctttgaacaggagatttactttgatgaagtccagatcatccaccagattggtgcaaagagagaccagattgtcctggaaaacctaaatcggtacaacaagcagctatctaaggtcttccctgaaactccagaaaagtggagtgcccaggcaattcctgaagcatcttacagacctgtgcaaggagccctgcgctggactgctttgcccacccccgccaaggatatgctgctgcaggtgggtgagaaggatgtgcctattaagaccaggagattgaagaagcaggcaaaatcactgcaggaggatgtgacctgggaactggtggtcctgcggaggatgctgaaggaatggaagactgcctgggctctgatcatagagtggcaccatgagacagtagagaacctgcttcagagcttgggagacctgcatgatgacgttcggatcaaagctatcaccacatgtgccacagctgctttggaacggccccggattgccaccagccagagagactcagacaagaccatccaggacttgccggaggttctactgcctgccctagaggctgctctttgtgacaagaatgcccatgtgcggatggcagcagcaatatgccaatatgccatacagtcacataatccccttgcccggaacatcatgcagactgcccttctgaagggtaacagtgtggatagctgggctgcagctcagtgcttggctctggaaggtactgctacttaccctgtgattaagaggatcctccaccagctgtttacaaagaagaatgaggacactgaggaacagtcttatatcctcctgagctatctgagtgagaagacaaccctgatacacaccatgcttgctgtggagctgaacagctgtcaatggaagaaccggattgtggcctgccaggctttctcccggatcagtggaaatgtctgcttggatatgaaacataagttgatccagctgatgtggaatgactggaataaggaagtgaggagagcagctgcacaggcgcttgggcaaatgagcctcgggaaagaggtgcacgacataatcagggtcaagctaggtcaaggaaattcccaggagcgtgtggaagctctctacctgataggtgagctcaagcttatgaccgccaagcttctcccaagcttcctgcactgcttctctgatgacttcacagcagttcggcgggcagcctgtttggcagctggtgccctgcagatccgcgacaagatggtgcttgaatgcctcctgaacctgatgcagagagatccttactggaaaatcaaggcctttgccattcgagctttgggacagattgggcaagtaagtcccgagctgacggatcttctgctctgggctatccactatgaagagtcaccaggtgtacggctggaagcttgccgtagcatcctagccctgaaacttcaaggggaccgggtcagggacaccttcctagacgtgctgctcctggagaaccacgatgctgttctaaaagaaatgtaccagacaatgaagatactcaacttaggaaatgaaggaaaccaagaaatgcttcaggagatcaagaacaggattaaaacactaagccaaaaggacttgctgacacacaaaatactcaagctggagatggtcatgggaaaagtgagggaggaagcaaaacgtgtttacttgaaacccaaaggagaacaaggaccactaacactccagactttactccaagaaacttttcaggatgagatggttcttcctagaagaccttccgaggtttgtgacactgaagcagtgataaagcctgtgaagccccgcgcaccaaatccctggttacaaagttcagtcccaggcctaaccacacgaagcaaagttcgttcatcacttgtcaaagatctacgcacctcccccgagaaaaggattgctgtgggaccatttagatccgactacccagctctttatctgggtaaattctcagagagaacatttttttctcccatcatgtcttctccctctggaaagaaaggtgctcatctctaagctgaacacttgtcttacttcaagatgcaggaagcagtggacctggtcacattgggtctttttaattgatactgtacaatcttgttgtcactatgtttataaagagaaattatttaacag

SEQ ID NO: 139710 - DNA, 552 bp, Homo sapiens
  Payload ID: 7398
  Gene Symbol: HEATR4
  Gene Name: HEAT repeat containing 4
  ENST ID: ENST00000557603
  CDS Start-End: 436-552
agaaccttgcttctctctgaggactgccttgtaggaggccatttggaaagtaattttgaaacactgctcctttgccagtatctgaaaggtgctggatggtgtcagctggaagatgaggggcaacctgagagacggagtttcaccatgttggtcaagctggtcttgaactcctaacctcagatgatccacacgcctcagcctcccaaagtgctgggattacacgcatgatccaccacgcctggccgattgacttaattttttatgctgtgtacaaaaggacccaggacctgccactctgcttttggttctagagggctatttgttggaagtgggtgctgcctcataatgctggtcacgtaatgtgtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggag

SEQ ID NO: 139711 - DNA, 824 bp, Homo sapiens
  Payload ID: 7398
  Gene Symbol: HEATR4
  Gene Name: HEAT repeat containing 4
  ENST ID: ENST00000556455
  CDS Start-End: 252-824
gaaggtttaagatgcagaaccttgcttctctctgaggactgccttgtaggaggccatttggaaagtaattttgaaacactgctcctttgccagtatctgaaaggtgctggatggtgtcagctggaagatgaggggcaacctgaggtagctgaaaaaactttggattaggtgtcaaaagggtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctgg

SEQ ID NO: 139712 - DNA, 623 bp, Homo sapiens
  Payload ID: 7398
  Gene Symbol: HEATR4
  Gene Name: HEAT repeat containing 4
  ENST ID: ENST00000563329
  CDS Start-End: 516-623
aacctaagaaaccaaggaaggcttaagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggcgcagtcccagcatttctggaggccaaggcaggaagatcgcttgattccaggagtttgaaaccagcctggacaacatatttgagcttcttcaagactactattttgaattccctgtctggaaaggtcacatatctctgtcactcctggattggtcactggtgccttatttagtccatttggtgaaataatgttttcctggatgttcttgatgcttgtggatggtcatcaatgtctggacattgaagagtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggc

SEQ ID NO: 139713 - DNA, 507 bp, Homo sapiens
  Payload ID: 7399
  Gene Symbol: HEATR5A
  Gene Name: HEAT repeat containing 5A
  Uniprot ID: Q86XA9
  ENST ID: ENST00000382464
  CDS Start-End: 135-476
agagcagccggtaacgttgctggaccgggacgcacgctcagctgaggaggacccccaaagatttttattgttaggtatattgaccaaagtttaacgagaagaactgtgatcagctgggaggattgctgcaaggaatggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagctgtaagtgaaacattaaaacagaacagaaaacaaaa

SEQ ID NO: 139714 - DNA, 7840 bp, Homo sapiens
  Payload ID: 7399
  Gene Symbol: HEATR5A
  Gene Name: HEAT repeat containing 5A
  ENST ID: ENST00000543095
  CDS Start-End: 186-6326
aatgcctcgctgtcgccgccgccggcaattccagactctgctagggttagcagagcagccggtaacgttgctggaccgggacgcacgctcagctgaggaggacccccaaagatttttattgttaggtatattgaccaaagtttaacgagaagaactgtgatcagctgggaggattgctgcaaggaatggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagcttgctgctgtggtatgtttgggttccttgtacaagaagttgggtagaatactgggtaacacctttactgatacagtggggaatattcttaaagctatgaagagtgcagagtctcaaggccgatatgagattatgctaagtctgcaaaatatattgaatggactaggagctgccgctgcaccttgtcacagggatgtttataaagctgctagatcctgcttgacagatagatccatggctgttcgttgtgctgctgcaaagtgtctccttgaacttcagaatgaagccatctttatgtggagtacggacctggacagtgtggccacactgtgttttaagtcctttgaaggttccaattatgatgtgcggatttctgtttcaaagttactaggcataatattagctaaagctgtaatttctaaacatccaggaacagcagcctcacgtcaaagcattcgcagagtatctttggaggaagttctggaattactaggaacagggtttctacgtgggagttcaggattccttcgagccagtggagatatgctgaaaggaaccagttcagtcagtagggatgttcgagttggagttactcaggcttatgtggtatttgtttcaacactaggaggagcttggctagagaaaaattttgctgcctttttttctcatatcctaagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaaggaagcatctcaattctccctactatattgtacctcacaatcggggtcctcagagagactgctgtgaagttacctgggggccagttatcttcgacagttgcagcttccctacaggctctaaaaggaatattatcttctcccatggcccgggcagaaaagagccgtactgcttggactgaccttctccgaagtgccttaacaacaattcttgactgttgggatccagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaagtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcatta

SEQ ID NO: 139715 - DNA, 5237 bp, Homo sapiens
  Payload ID: 7399
  Gene Symbol: HEATR5A
  Gene Name: HEAT repeat containing 5A
  ENST ID: ENST00000538864
  CDS Start-End: 1-4799
ttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtg

SEQ ID NO: 139716 - DNA, 586 bp, Homo sapiens
  Payload ID: 7399
  Gene Symbol: HEATR5A
  Gene Name: HEAT repeat containing 5A
  ENST ID: ENST00000550819
  CDS Start-End: 1-373
cttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctggtaagtattggacattatcagttaaaataataaaattgaaatttgaaactttacataaaattgtttaccactgagaattcatcagtcttgtctaactagctggattctgactgtctgattgttgcttttcttcaaatgaagattgtatttctagtgttttagaattctctgtaatttgaacaatataaatccaatacttaagcctgctctttttccctttggctgtcttagatgactttcctatataaaacaaattaaaaagtaaagttattgtttatgccctaaaa

SEQ ID NO: 139717 - DNA, 598 bp, Homo sapiens
  Payload ID: 7399
  Gene Symbol: HEATR5A
  Gene Name: HEAT repeat containing 5A
  ENST ID: ENST00000549719
  CDS Start-End: 1-598
tttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgagatcttgttggataattctgtgttggtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaa

SEQ ID NO: 139718 - DNA, 480 bp, Homo sapiens
  Payload ID: 7399
  Gene Symbol: HEATR5A
  Gene Name: HEAT repeat containing 5A
  ENST ID: ENST00000549184
  CDS Start-End: 219-480
cggtcgaggggctaggtgtcttgaccctaagggctggagtccgccgagaaggggctgactggggcacagggtcggctgataaacagcgtggtccgttcttcctcctggactacgggaaagtctggcttcacctgtgcacaacagatttttattgttaggtatattgaccaaagtttaacgagaagaactgtgatcagctgggaggattgctgcaaggaatggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccg

SEQ ID NO: 139719 - DNA, 2687 bp, Homo sapiens
  Payload ID: 7399
  Gene Symbol: HEATR5A
  Gene Name: HEAT repeat containing 5A
  ENST ID: ENST00000550366
  CDS Start-End: 1-2687
gtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcac

SEQ ID NO: 139720 - DNA, 6905 bp, Homo sapiens
  Payload ID: 7400
  Gene Symbol: HEATR5B
  Gene Name: HEAT repeat containing 5B
  Uniprot ID: Q9P2D3
  ENST ID: ENST00000233099
  CDS Start-End: 97-6312
ggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggaccacctacacgaaaattattagctaaaaatctcgcagccctttatagcattggggatactttcacagtttttcagacacttgataaatgcaatgacattatcagaaataaagatgacactgcggcctacttaccaacaaaattggctgcggtggcttgtgtcggagcattttatgaaaaaatggggagaatgttgggcagcgcatttccagaaacggtaaataatctattgaaatctctgaaaagtgcagagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggctgcccgacttgctgctgcatggtgtttgcgctgtgtggctgtggcattacctttccagctgacaccatttctagacaggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagcatttcccaaaatgtccttatctttctgatggatcttttagctttcatatcaaattactaaattatgctatgtatattttagttggtaacaattaaaattctcatttaaaggtt

SEQ ID NO: 139721 - DNA, 433 bp, Homo sapiens
  Payload ID: 7400
  Gene Symbol: HEATR5B
  Gene Name: HEAT repeat containing 5B
  ENST ID: ENST00000425467
  CDS Start-End: 1-348
gttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacattctaggtagtcagcctgaatctactttacgttccctgcctccagaccctattctcctgcctcctgcccacaactcccaggctccagtgatctacccgcctcggcctcccaaagtgctgggattacaggcgtgagccatggcgcctggccaaaatgtaaatgagtcctcgtaaagcaaaaaaagtattgtgagtaataaagttgaactacgaattaaaa

SEQ ID NO: 139722 - DNA, 3932 bp, Homo sapiens
  Payload ID: 7401
  Gene Symbol: HEATR6
  Gene Name: HEAT repeat containing 6
  Uniprot ID: Q6AI08
  ENST ID: ENST00000184956
  CDS Start-End: 18-3563
ccccgcccgtagaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacaggtaattgttgatgaacagcacttggatttcctgttggcatatactatttcggctattcatcagtgtagttcctggacacacagggaaattcttcaagccctggcagctctggtgtactgcaatggctccaaatgtcaaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagagatgcccacggtgttatacccaactccgcttcctcagtatgatgggcgaacacctatcaaaccacagcaatcagaatccagtgcttctcgaccaactttgaataaaaagaaaaaatccaaagtaaaaccaaagaaaatccagcaaggagaggaggaggaaaaggaatccagtggtgaaatagaggcagccccagtcactggcacaggcagagtgaacctgcatgaagggaacacttggtgtccctcctccctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaagcccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttacaggtattgactcttctggcaaggggctacttttcaatgactcaagcctacttgatggagcttggagaggtgatttgcaagtgcatgggggaagcagatccatccattcagcttcatggagcaaagcttctggaagaactgggcacaggcttaatacagcagtataaaccagactccactgcagcacctgatcagagagcaccagtcttcttggtggtgatgttctggactatgatgctgaacggtcctttacccagagccctgcagaattcagaacacccaactctccaggcgagcgcctgtgatgccctgtcttccatcttgccagaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtgaagatcccaccatactttctagatgtcgaaggcggcagtaggaagacctgagcttgagcataagatctgtgggatttcatcttaggggcagaaacaatccgttcactatttatttagaatgacttagcagccatttaaattttcacagagggctcaaccacctttggagtgactccatagcactggccatggtcagggttgttggaacatctgacctgtgcatccaggagccgaggagtcaggttgtaatacaggccaagcagacgggctttgagggcatttagtctcagaaaaaaaaaatgtagaaggatttcggaattagaattttgtgtattgtatctgtagttttgtaataaactaacgaaaaata

SEQ ID NO: 139723 - DNA, 3288 bp, Homo sapiens
  Payload ID: 7401
  Gene Symbol: HEATR6
  Gene Name: HEAT repeat containing 6
  ENST ID: ENST00000585976
  CDS Start-End: 8-3217
agaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacaggtaattgttgatgaacagcacttggatttcctgttggcatatactatttcggctattcatcagtgtagttcctggacacacagggaaattcttcaagccctggcagctctggtgtactgcaatggctccaaatgtcaaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagagatgcccacggtgttatacccaactccgcttcctcagtatgatgggcgaacacctatcaaaccacagcaatcagaatccagtgcttctcgaccaactttgaataaaaagaaaaaatccaaagtaaaaccaaagaaaatccagcaaggagaggaggaggaaaaggaatccagtggtgaaatagaggcagccccagtcactggcacaggcagagtgaacctgcatgaagggaacacttggtgtccctcctccctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaagcccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtgaagatcccaccatactttctagatgtcgaaggcggcagtaggaagacctgagcttgagcataagatctgtgg

SEQ ID NO: 139724 - DNA, 550 bp, Homo sapiens
  Payload ID: 7401
  Gene Symbol: HEATR6
  Gene Name: HEAT repeat containing 6
  ENST ID: ENST00000593228
  CDS Start-End: 1-550
ggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattt

SEQ ID NO: 139725 - DNA, 687 bp, Homo sapiens
  Payload ID: 7401
  Gene Symbol: HEATR6
  Gene Name: HEAT repeat containing 6
  ENST ID: ENST00000587314
  CDS Start-End: 1-162
gccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaa

SEQ ID NO: 139726 - DNA, 843 bp, Homo sapiens
  Payload ID: 7401
  Gene Symbol: HEATR6
  Gene Name: HEAT repeat containing 6
  ENST ID: ENST00000590587
  CDS Start-End: 1-74
atcatcttgtcagcaaagtgagccagcttatccaccatttacttaacagattacagctgccaatgtctggttagttcaaggaaaagttacaaggacttcatcaagttctactttactaaagaggaagaagtgagcaagaccttggggtggggagaaggcccctacgttgatcaaactttcaggccctttagaggtgatccttttgacacataaacgacagacacacactctctcttttatacagcttgattcaggtgagcatacatgtccataaaagcataatattttttaaaagttagatcagaatatatcttttcctgtcctgttaggtaattgttgatgaacagcacttggatttcctgttggcatatactatttcggctattcatcagtgtagttcctggacacacagggaaattcttcaagccctggcagctctggtgtactgcaatggctccaaatgtcaaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagaga

SEQ ID NO: 139727 - DNA, 573 bp, Homo sapiens
  Payload ID: 7401
  Gene Symbol: HEATR6
  Gene Name: HEAT repeat containing 6
  ENST ID: ENST00000592664
  CDS Start-End: 8-352
agaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacagctgccaatgtctggttagttcaaggaaaagttacaaggacttcatcaagttctactttactaaagaggaagaagtgagcaagaccttggggtggggagaaggcccctacgttgatcaaactttcaggccctttagaggtgatccttttgacacataaacgacagacacacactctctcttttatacagcttgattcaggtaattgttgatgaacagcacttggatttcctgttggcata

SEQ ID NO: 139728 - DNA, 490 bp, Homo sapiens
  Payload ID: 7401
  Gene Symbol: HEATR6
  Gene Name: HEAT repeat containing 6
  ENST ID: ENST00000591683
  CDS Start-End: 1-363
ctggaagaactgggcacaggcttaatacagcagtataaaccagactccactgcagcacctgatcagagagcaccagtcttcttggtggtgatgttctggactatgatgctgaacggtcctttacccagagccctgcagaattcagaacacccaactctccaggcgagcgcctgtgatgccctgtcttccatcttgccagaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtct

SEQ ID NO: 139729 - DNA, 3566 bp, Homo sapiens
  Payload ID: 7401
  Gene Symbol: HEATR6
  Gene Name: HEAT repeat containing 6
  ENST ID: ENST00000587003
  CDS Start-End: 8-1249
agaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacaggtaattgttgatgaacagcacttggatttcctgttggcatatactatttcggctattcatcagtgtagttcctggacacacagggaaattcttcaagccctggcagctctggtgtactgcaatggctccaaatgtcaaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagagatgcccacggtgttatacccaactccgcttcctcagtatgatgggcgaacacctatcaaaccacagcaatcagaatccagtgcttctcgaccaactttgaataaaaagaaaaaatccaaagtaaaaccaaagaaaatccagcaaggagaggaggaggaaaaggaatccagtggtgaaatagaggcagccccagtcactggcacaggcagagtgaacctgcatgaagggaacacttggtgtccctcctccctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtagttatgaaaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaagcccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttacaggtattgactcttctggcaaggggctacttttcaatgactcaagcctacttgatggagcttggagaggtgatttgcaagtgcatgggggaagcagatccatccattcagcttcatggagcaaagcttctggaagaactgggcacaggcttaatacagcagtataaaccagactccactgcagcacctgatcagagagcaccagtcttcttggtggtgatgttctggactatgatgctgaacggtcctttacccagagccctgcagaattcagaacacccaactctccaggcgagcgcctgtgatgccctgtcttccatcttgccagaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtga

SEQ ID NO: 139730 - DNA, 648 bp, Homo sapiens
  Payload ID: 7401
  Gene Symbol: HEATR6
  Gene Name: HEAT repeat containing 6
  ENST ID: ENST00000593097
  CDS Start-End: 8-648
agaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacagagtttcacactgttgcccaggctggagtgtggcgcgatctcagctcacagcaagctccgcctcccgagtttacaccattcttctgcctcagcctcccaagtagctgggactacaggcacccgccaccacgtaattgttgatgaacagcacttggatttcctgttggcatatactatttcggctattcatcagtgtagttcctggacacacagggaaattcttcaagccctggcagctctggtgtactgcaatggctccaaatgtcaaaagtacctcccagagctgctaggcaacaccggactcttaatgaagtt

SEQ ID NO: 139731 - DNA, 3287 bp, Homo sapiens
  Payload ID: 7401
  Gene Symbol: HEATR6
  Gene Name: HEAT repeat containing 6
  ENST ID: ENST00000613428
  CDS Start-End: 466-3216
agaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacaggtaattgttgatgaacagcacttggatttcctgttggcatatactatttcggctattcatcagtgtagttcctggacacacagggaaattcttcaagccctggcagctctggtgtactgcaatggctccaaatgtcaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagagatgcccacggtgttatacccaactccgcttcctcagtatgatgggcgaacacctatcaaaccacagcaatcagaatccagtgcttctcgaccaactttgaataaaaagaaaaaatccaaagtaaaaccaaagaaaatccagcaaggagaggaggaggaaaaggaatccagtggtgaaatagaggcagccccagtcactggcacaggcagagtgaacctgcatgaagggaacacttggtgtccctcctccctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaagcccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtgaagatcccaccatactttctagatgtcgaaggcggcagtaggaagacctgagcttgagcataagatctgtgg

SEQ ID NO: 139732 - DNA, 1829 bp, Homo sapiens
  Payload ID: 7402
  Gene Symbol: HEATR9
  Gene Name: HEAT repeat containing 9
  Uniprot ID: A2RTY3
  ENST ID: ENST00000603870
  CDS Start-End: 130-1722
agaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacagctgaaggagaaaaatgagggtcaaaggatggagactttgacggggctacgaatggctcttaactcctgggctgctgtctctaaagacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatgagaaaacaatctatacttatcttccgtgaataaacaagtgtcactct

SEQ ID NO: 139733 - DNA, 1974 bp, Homo sapiens
  Payload ID: 7402
  Gene Symbol: HEATR9
  Gene Name: HEAT repeat containing 9
  Uniprot ID: A2RTY3
  ENST ID: ENST00000604834
  CDS Start-End: 150-1862
acttggaagcttctacctccagaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacagctgaaggagaaaaatgagggtcaaaggatggagactttgacggggctacgaatggctcttaactcctgggctgctgtctctaaagacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatgagaaaacaatctatacttatcttccgtgaataaacaagtgtcactctaccta

SEQ ID NO: 139734 - DNA, 549 bp, Homo sapiens
  Payload ID: 7402
  Gene Symbol: HEATR9
  Gene Name: HEAT repeat containing 9
  ENST ID: ENST00000603218
  CDS Start-End: 130-549
agaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggaactcacaaaaagcctggaatctcccagagaggatgagcagttctatgcagcacaggctctgggatgcttacgcatcagtgacaag

SEQ ID NO: 139735 - DNA, 1903 bp, Homo sapiens
  Payload ID: 7402
  Gene Symbol: HEATR9
  Gene Name: HEAT repeat containing 9
  ENST ID: ENST00000603323
  CDS Start-End: 86-937
aggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacagctgaaggagaaaaatgagggtcaaaggatggagactttgacggggctacgaatggctcttaactcctgggctgctgtctctaaagacaaggtgattgggaggacagtctttaattgggggcaaagctggacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatga

SEQ ID NO: 139736 - DNA, 1521 bp, Homo sapiens
  Payload ID: 7402
  Gene Symbol: HEATR9
  Gene Name: HEAT repeat containing 9
  Uniprot ID: A2RTY3
  ENST ID: ENST00000605080
  CDS Start-End: 216-1238
acttggaagcttctacctccagaagtccagacacctcccctgtacctctcgtaccacagaggacaggtcaatgttcctgtacccatggctggaatatccagacaagaccaaaggtgaggctgggatggacagaaatggagccaagagcaggggactgaaaaagaaatgctacctggctctcactcccaggcaagggtctagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacagctgaaggagaaaaatgagggtcaaaggatggagactttgacggggctacgaatggctcttaactcctgggctgctgtctctaaagacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcaaacaagagaaggaaatgaatgaaattagcatcactttgcctaattcgctctggacctgaaaagcaaccagcctcccttccacttcccctactccttaattcaactataacatactcactcccttctacacagacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctca

SEQ ID NO: 139737 - DNA, 1528 bp, Homo sapiens
  Payload ID: 7402
  Gene Symbol: HEATR9
  Gene Name: HEAT repeat containing 9
  Uniprot ID: A2RTY3
  ENST ID: ENST00000603852
  CDS Start-End: 215-1357
cttggaagcttctacctccagaagtccagacacctcccctgtacctctcgtaccacagaggacaggtcaatgttcctgtacccatggctggaatatccagacaagaccaaaggtgaggctgggatggacagaaatggagccaagagcaggggactgaaaaagaaatgctacctggctctcactcccaggcaagggtctagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacagctgaaggagaaaaatgagggtcaaaggatggagactttgacggggctacgaatggctcttaactcctgggctgctgtctctaaagacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcaaacaagagaaggaaatgaatgaaattagcatcactttgcctaattcgctctggacctgaaaagcaaccagcctcccttccacttcccctactccttaattcaactataacatactcactcccttctacacagacaactgatgaacccagatgccactgcacgccaggaagcagtcatctctttgggtgt

SEQ ID NO: 139738 - DNA, 1974 bp, Homo sapiens; identical to SEQ ID NO: 139733
  Payload ID: 7402
  Gene Symbol: HEATR9
  Gene Name: HEAT repeat containing 9
  Uniprot ID: A2RTY3
  ENST ID: ENST00000614305
  CDS Start-End: 150-1862

SEQ ID NO: 139739 - DNA, 1528 bp, Homo sapiens; identical to SEQ ID NO: 139737
  Payload ID: 7402
  Gene Symbol: HEATR9
  Gene Name: HEAT repeat containing 9
  Uniprot ID: A2RTY3
  ENST ID: ENST00000633642
  CDS Start-End: 215-1357

SEQ ID NO: 139740 - DNA, 1521 bp, Homo sapiens; identical to SEQ ID NO: 139736
  Payload ID: 7402
  Gene Symbol: HEATR9
  Gene Name: HEAT repeat containing 9
  Uniprot ID: A2RTY3
  ENST ID: ENST00000632179
  CDS Start-End: 216-1238

SEQ ID NO: 139741 - DNA, 1829 bp, Homo sapiens; identical to SEQ ID NO: 139732
  Payload ID: 7402
  Gene Symbol: HEATR9
  Gene Name: HEAT repeat containing 9
  Uniprot ID: A2RTY3
  ENST ID: ENST00000632969
  CDS Start-End: 130-1722

SEQ ID NO: 139742 - DNA, 1903 bp, Homo sapiens; identical to SEQ ID NO: 139735
  Payload ID: 7402
  Gene Symbol: HEATR9
  Gene Name: HEAT repeat containing 9
  ENST ID: ENST00000631921
  CDS Start-End: 86-937

SEQ ID NO: 139743 - DNA, 5191 bp, Homo sapiens
  Payload ID: 7403
  Gene Symbol: HSPH1
  Gene Name: heat shock 105kDa/110kDa protein 1
  Uniprot ID: Q92598
  ENST ID: ENST00000320027
  CDS Start-End: 346-2922
gaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacgtacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgttta

SEQ ID NO: 139744 - DNA, 3480 bp, Homo sapiens
  Payload ID: 7403
  Gene Symbol: HSPH1
  Gene Name: heat shock 105kDa/110kDa protein 1
  Uniprot ID: Q92598
  ENST ID: ENST00000380405
  CDS Start-End: 346-2790
gaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttct

SEQ ID NO: 139745 - DNA, 4987 bp, Homo sapiens
  Payload ID: 7403
  Gene Symbol: HSPH1
  Gene Name: heat shock 105kDa/110kDa protein 1
  ENST ID: ENST00000445273
  CDS Start-End: 295-2643
acacttctcccagcgggactacgattcccaacatgctctccggacagctggccggcctccccaccatcccggtgtctggggtctctgcaaaaatggggtctgtctccgcccgcccagcctccctttagcgttaaggatcggacaccacctcccggtagtaaattgtgactattccgagttttggagtcattcttcgttgcctgttttattagggcagcaaaacgcctgtggctagggcgggagtgggcggaggcaggtttgagccaatggcacgggagcggccctgtcgctgccatggcaacggcggccgttctccggggaccggctgcccattgggtagaatctttccagaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacgtacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcattttaaattgtcattttgtgacaatatttctaaacaacgtccatttttaataac

SEQ ID NO: 139746 - DNA, 812 bp, Homo sapiens
  Payload ID: 7403
  Gene Symbol: HSPH1
  Gene Name: heat shock 105kDa/110kDa protein 1
  ENST ID: ENST00000435381
  CDS Start-End: 1-348
gatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatgattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaa

SEQ ID NO: 139747 - DNA, 3488 bp, Homo sapiens
  Payload ID: 7403
  Gene Symbol: HSPH1
  Gene Name: heat shock 105kDa/110kDa protein 1
  ENST ID: ENST00000602786
  CDS Start-End: 346-693
gaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttct

SEQ ID NO: 139748 - DNA, 3570 bp, Homo sapiens
  Payload ID: 7403
  Gene Symbol: HSPH1
  Gene Name: heat shock 105kDa/110kDa protein 1
  Uniprot ID: Q92598
  ENST ID: ENST00000630972
  CDS Start-End: 295-2877
acacttctcccagcgggactacgattcccaacatgctctccggacagctggccggcctccccaccatcccggtgtctggggtctctgcaaaaatggggtctgtctccgcccgcccagcctccctttagcgttaaggatcggacaccacctcccggtagtaaattgtgactattccgagttttggagtcattcttcgttgcctgttttattagggcagcaaaacgcctgtggctagggcgggagtgggcggaggcaggtttgagccaatggcacgggagcggccctgtcgctgccatggcaacggcggccgttctccggggaccggctgcccattgggtagaatctttccagaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaa

SEQ ID NO: 139749 - DNA, 950 bp, Homo sapiens
  Payload ID: 7404
  Gene Symbol: HSPE1
  Gene Name: heat shock 10kDa protein 1
  Uniprot ID: P61604
  ENST ID: ENST00000233893
  CDS Start-End: 444-752
cctacccgcgcagggtgtgctagcgcgctcagccctctccggccggcttagtctagttcccgggcctcgctcggttccagaactttccagaaaatgccgcgctccctacggctcaagggtcaaatcgcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgaccgctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgagtggttaa

SEQ ID NO: 139750 - DNA, 570 bp, Homo sapiens
  Payload ID: 7404
  Gene Symbol: HSPE1
  Gene Name: heat shock 10kDa protein 1
  ENST ID: ENST00000409468
  CDS Start-End: 59-364
gcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgac

SEQ ID NO: 139751 - DNA, 478 bp, Homo sapiens
  Payload ID: 7404
  Gene Symbol: HSPE1
  Gene Name: heat shock 10kDa protein 1
  ENST ID: ENST00000409729
  CDS Start-End: 298-441
cgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgaccgctggggcgagcgcgcctgcgcgctgggtgattttttcacgtgtcgccagggccggactgcgagtctctttgcggcgctacactagagcagagtacgagtctgaggcggagggagtaatgggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctg

SEQ ID NO: 139752 - DNA, 2152 bp, Homo sapiens
  Payload ID: 7405
  Gene Symbol: HSPB8
  Gene Name: heat shock 22kDa protein 8
  Uniprot ID: Q9UJY1
  ENST ID: ENST00000281938
  CDS Start-End: 672-1262
attaatagccaggccttagtgccccgctcggggagggcggctccagctcctggagcaagaggagggcggagctgagcggagtggccaggggaggagagagtgtccggagaggccggctgaacttggacgcggcccctcccagctccccccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttcttagc

SEQ ID NO: 139753 - DNA, 637 bp, Homo sapiens
  Payload ID: 7405
  Gene Symbol: HSPB8
  Gene Name: heat shock 22kDa protein 8
  ENST ID: ENST00000541798
  CDS Start-End: 1-458
gggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccaggaacataatacaactggatctaagcttaagcaaacacgtgatgagggaacaagtaaacaggcagacaaaatcgttactggagtaggaggctgtggacatctgaagaaataccacagaggaagcctatactgccatctttttctcattttttctgacaggatctatatcaattccttttttccattccttaattctattatttttaactacataagacattttgttacaggaaaaccagaaaacccgaaaacccagaagaaaatgaaaatcattcacattccctcctttcagagaaggctatgactattacattttcattgcttttttcccatcaactttcacatgcaccaacatatagagagtattgtttttaatattattttacagaaatggtatcaaacttggtgtatttcctcctctttattagtacatatcacgagtgtctttccttgctaataaatatggattgagttaatgtttaa

SEQ ID NO: 139754 - DNA, 909 bp, Homo sapiens
  Payload ID: 7406
  Gene Symbol: HSPB1
  Gene Name: heat shock 27kDa protein 1
  Uniprot ID: P04792
  ENST ID: ENST00000248553
  CDS Start-End: 170-787
gctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 139755 - DNA, 527 bp, Homo sapiens
  Payload ID: 7406
  Gene Symbol: HSPB1
  Gene Name: heat shock 27kDa protein 1
  ENST ID: ENST00000429938
  CDS Start-End: 292-405
agctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 139756 - DNA, 1455 bp, Homo sapiens
  Payload ID: 7406
  Gene Symbol: HSPB1
  Gene Name: heat shock 27kDa protein 1
  ENST ID: ENST00000447574
  CDS Start-End: 26-586
gacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttct

SEQ ID NO: 139757 - DNA, 1335 bp, Homo sapiens
  Payload ID: 7407
  Gene Symbol: HSPB2
  Gene Name: heat shock 27kDa protein 2
  Uniprot ID: Q16082
  ENST ID: ENST00000304298
  CDS Start-End: 589-1137
tgatggtcaacatgtcagcaccagccatctgcctcgtgccctgggttgacctgggtttaggagaggatcccacatctgggcagaaagaccccaccccctgaaaaaagagcaaacagatttcttgcatctttcgttctatgtggctctcagaacattaaatccaggagtgctttaggaattgggtgcacagtgcctgccaccgaagaggagaaaatgaggtgtggaaacgtgcaaaccgtttgtgagggtctcagcgaggcctcttcatgccccaggcaccaccagctccccctccccagctcgttcccagccaggaccctcagctgtcctctcaggccccctgcgacagctgaagagtgtgcgggggaggggactaggggtccgggcggcgctggtcacaccctcgttgctctcactcagggcccccactcccagcccctccccccccaagaggctcggcactattttgggtggtgtcgaccccgcccccacctcctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatctcagggc

SEQ ID NO: 139758 - DNA, 784 bp, Homo sapiens
  Payload ID: 7408
  Gene Symbol: HSPB3
  Gene Name: heat shock 27kDa protein 3
  Uniprot ID: Q12988
  ENST ID: ENST00000302005
  CDS Start-End: 190-642
gaaaagacaagagagcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggtgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagttcctggta

SEQ ID NO: 139759 - DNA, 2892 bp, Homo sapiens
  Payload ID: 7409
  Gene Symbol: HSPB7
  Gene Name: heat shock 27kDa protein family, member 7 (cardiovascular)
  Uniprot ID: Q9UBY9
  ENST ID: ENST00000311890
  CDS Start-End: 828-1340
cttttacctctgactgaaatcccacctaaggcgctcgcaggcatcacctctgacacagagatggagcagacagttgccgggaacacaaccttctagacctttaaggagaaagctgccaactttgtcctcttggggctgctgaatgttctgagagtcagagggagtgcaggcacagaatccaggtccccatgggggctggcaggggacagctgcacattttacaccccctggcagggctcaacctttccttagagatgggctgtgaaggttgtctgccttgagggaaggagctcctgacgtcacagagcggtggtgcttccacctaccctgtccccaaggagcctgcacactgatggaggaggtacagccgtggaggagaaccagagtctggaggggaggcacagtcctcaggagcccccaggctgacgggggaaacaaaacacacaataaaccccaaacttgcaaggttctggggcaggcaccgaggtccgagtggcaaggagacaggatccagccctgtgcagtggtgaggaggcccctggggctgctgtgatcagcctggaatgtcaggctgtgagctcagccctctcggcctgcgtgtcgggctgtcagcagggccggcgcacgggagaagatttccagccccctctgggccatggagaggcctaaatttagctagtagacaaggggctggccccaagcccagggacagtcggccttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacagac

SEQ ID NO: 139760 - DNA, 2415 bp, Homo sapiens
  Payload ID: 7409
  Gene Symbol: HSPB7
  Gene Name: heat shock 27kDa protein family, member 7 (cardiovascular)
  ENST ID: ENST00000375718
  CDS Start-End: 126-863
actccacataccaccagcaccgctaatacccctgtagaaggagctctccaggatgaagctccagactgggttgtagggggctcagacaaaagagaaactgcccgtcttcaagaaccttcaatctaatggggagacaggtgaaccctcgcccccgtgggaactgccagttggatagggaagaagggacacagcagagagtcacagcacacaggaagactatgtcacactgccaggtgctgtgggaggacaaagacagtcagtgctgggggcatctggactgggtgtgggcccatgtgagcaggagcagtcagagaggcctccctgggggaggaggcattggagctgatctgggacggaagggacggatttggagaggacagcagaggcccttaactgcaacctgggcagagcagagggcctggccgcctctcagaatggcctccaccctggcccagggcaaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacagac

SEQ ID NO: 139761 - DNA, 648 bp, Homo sapiens
  Payload ID: 7409
  Gene Symbol: HSPB7
  Gene Name: heat shock 27kDa protein family, member 7 (cardiovascular)
  ENST ID: ENST00000406363
  CDS Start-End: 43-567
ccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccag

SEQ ID NO: 139762 - DNA, 2128 bp, Homo sapiens
  Payload ID: 7409
  Gene Symbol: HSPB7
  Gene Name: heat shock 27kDa protein family, member 7 (cardiovascular)
  ENST ID: ENST00000411503
  CDS Start-End: 79-576
gctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacagac

SEQ ID NO: 139763 - DNA, 581 bp, Homo sapiens
  Payload ID: 7409
  Gene Symbol: HSPB7
  Gene Name: heat shock 27kDa protein family, member 7 (cardiovascular)
  ENST ID: ENST00000463576
  CDS Start-End: 1-375
atgttttccgatgactttggcagcttcatgcggccccactcggagcccctggccttcccagcagcccatcccacagcccgccccggtggggcaggcaacatcaagaccctaggagacgcctatgagtttgcggtggacgtgagagacttctcacctgaagacatcattgtcaccacctccaacaaccacatcgagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgccca

SEQ ID NO: 139764 - DNA, 844 bp, Homo sapiens
  Payload ID: 7409
  Gene Symbol: HSPB7
  Gene Name: heat shock 27kDa protein family, member 7 (cardiovascular)
  Uniprot ID: Q9UBY9
  ENST ID: ENST00000487046
  CDS Start-End: 111-638
cttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgccca

SEQ ID NO: 139765 - DNA, 2299 bp, Homo sapiens
  Payload ID: 7410
  Gene Symbol: HSPD1
  Gene Name: heat shock 60kDa protein 1 (chaperonin)
  Uniprot ID: P10809
  ENST ID: ENST00000345042
  CDS Start-End: 118-1839
gccccgacgcgcaccgcgattcgccccaagggccctgcgcaggacgctgacgcgaagactcggaggcggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagtt

SEQ ID NO: 139766 - DNA, 2455 bp, Homo sapiens
  Payload ID: 7410
  Gene Symbol: HSPD1
  Gene Name: heat shock 60kDa protein 1 (chaperonin)
  Uniprot ID: P10809
  ENST ID: ENST00000388968
  CDS Start-End: 269-1990
agactaagccggccggagagggctgagcgcgctagcacaccctgcgcgggtagggaggggcggggctcgcgcgcagggtgtgcagattgcagggcccgggctgacgggaagtgggtgggagctgcctgcacacgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaataa

SEQ ID NO: 139767 - DNA, 619 bp, Homo sapiens
  Payload ID: 7410
  Gene Symbol: HSPD1
  Gene Name: heat shock 60kDa protein 1 (chaperonin)
  ENST ID: ENST00000440114
  CDS Start-End: 44-190
gacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggcaagtgtgtttgtatt

SEQ ID NO: 139768 - DNA, 754 bp, Homo sapiens
  Payload ID: 7410
  Gene Symbol: HSPD1
  Gene Name: heat shock 60kDa protein 1 (chaperonin)
  ENST ID: ENST00000430176
  CDS Start-End: 52-754
cggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagatggaaaaacactgaatgatgaattagaaattattgaaggcatgaagtttgatcgaggctatatttctccatactttattaatacatcaaaaggtaagaaca

SEQ ID NO: 139769 - DNA, 549 bp, Homo sapiens
  Payload ID: 7410
  Gene Symbol: HSPD1
  Gene Name: heat shock 60kDa protein 1 (chaperonin)
  ENST ID: ENST00000428204
  CDS Start-End: 268-549
attgcggtgtgcgccctgcactctgtccctcactcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattgga

SEQ ID NO: 139770 - DNA, 578 bp, Homo sapiens
  Payload ID: 7410
  Gene Symbol: HSPD1
  Gene Name: heat shock 60kDa protein 1 (chaperonin)
  ENST ID: ENST00000439605
  CDS Start-End: 329-578
actcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaa

SEQ ID NO: 139771 - DNA, 533 bp, Homo sapiens
  Payload ID: 7410
  Gene Symbol: HSPD1
  Gene Name: heat shock 60kDa protein 1 (chaperonin)
  ENST ID: ENST00000418022
  CDS Start-End: 359-533
ccctcactcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtgggtctgcccacaaggccgttttcgcgaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagg

SEQ ID NO: 139772 - DNA, 888 bp, Homo sapiens
  Payload ID: 7410
  Gene Symbol: HSPD1
  Gene Name: heat shock 60kDa protein 1 (chaperonin)
  ENST ID: ENST00000452200
  CDS Start-End: 226-888
gaagactcggaggcggaagaaaaaaggagctgtttctaggcttttctaggcgcccagccgaggtgaaagaactaccccttcgtcccctcccggaaatgacgcgatttgacccttgagccgtagggagcgcggcattttctggaaagttctggaaccgagcgaggcccgggaactagactaagccggccggagagggctgagcgcgctagcacaccctgcgcggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcga

SEQ ID NO: 139773 - DNA, 529 bp, Homo sapiens
  Payload ID: 7410
  Gene Symbol: HSPD1
  Gene Name: heat shock 60kDa protein 1 (chaperonin)
  ENST ID: ENST00000426480
  CDS Start-End: 5-529
agtgatgaaaacttgctggaccagagaacagctccagggaaagcggcagggagaggtggtcaaagggaaacaaggaggagaatatcggcacccggatccggctagacaagctggatggcaggaaacggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaa

SEQ ID NO: 139774 - DNA, 3151 bp, Homo sapiens
  Payload ID: 7411
  Gene Symbol: HSPA12B
  Gene Name: heat shock 70kD protein 12B
  Uniprot ID: Q96MM6
  ENST ID: ENST00000254963
  CDS Start-End: 146-2206
gaggaggcgggaggcctcagggccgggcgcacgtcgagggctgcggccgccgcagcgggcacggccaacgagctgcgggcccgggatcgcggcggctggacggggctggagctgtcgggagggcggagctacagggcctgcaaggatgttggctgtcccggagatgggcctgcaggggctgtacatcggctccagcccggagcggtccccagtgcctagcccacccggctccccgaggacccaggaaagctgcggcattgcccccctcacaccctcgcagtctccaaaacccgaggtccgagccccccagcaggcctccttctctgtggtggtggccattgacttcggcaccacgtctagtggctatgctttcagctttgccagtgaccctgaggccatccacatgatgaggaaatgggagggcggagacccgggcgtggcccaccagaagaccccgacctgcctgctgctgactccggagggcgccttccacagctttggctacaccgcccgcgattactaccatgacctggaccccgaagaggcgcgggactggctctacttcgagaagttcaagatgaagatccacagcgccacggatctcaccttgaagacccagctagaggcagtaaatggaaagacgatgcccgccctggaggtgttcgcccatgccctgcgcttcttcagggagcacgcccttcaggagctgagggagcagagcccatcgctgccagagaaggacactgtgcgctgggtgttgacggtgcctgccatctggaaacagccagccaagcagttcatgcgggaggctgcctacctggctggactagtgtcccgagagaatgcagagcagctactcatcgccctggagcccgaggccgcctcggtatactgccgcaagctgcgcctgcaccagctcctggacctgagtggccgggccccaggtggtgggcgcctgggtgagcgccgctccatcgactccagcttccgtcaggctcgggagcagctgcgaaggtcccgccacagccgcacgttcctggtggagtcaggcgtaggagagctgtgggcagagatgcaagcaggagaccgctacgtggtggccgactgcggcggaggcaccgtggacctgacggtgcaccagctggagcagccccatggcaccctcaaggagctctacaaggcatctgggggcccttatggcgcggtgggcgtggacctggccttcgagcagctgctgtgccgcatcttcggcgaggacttcatcgccaccttcaaaaggcaacggccggcagcctgggtagatctgaccatcgccttcgaggctcgcaagcgcactgctggcccacaccgtgcaggggcgctcaacatctcgctgcccttctccttcattgacttctaccgcaagcagcggggccacaacgtggagaccgctctgcgcaggagcagcgtgaacttcgtgaagtggtcctcacaggggatgctccgaatgtcttgtgaagccatgaacgagctctttcagcccaccgtcagcgggatcatccagcacatagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaaggggaa

SEQ ID NO: 139775 - DNA, 3009 bp, Homo sapiens
  Payload ID: 7411
  Gene Symbol: HSPA12B
  Gene Name: heat shock 70kD protein 12B
  ENST ID: ENST00000399701
  CDS Start-End: 262-2064
ggccgccgcagcgggcacggccaacgagctgcgggcccgggatcgcggcggctggacggggctggagctgtcgggagggcggagctacagggcctgcaaggatgttggctgtcccggagatgggcctgcaggggctgtacatcgaaacccgaggtccgagccccccagcaggcctccttctctgtggtggtggccattgacttcggcaccacgtctagtggctatgctttcagctttgccagtgaccctgaggccatccacatgatgaggaaatgggagggcggagacccgggcgtggcccaccagaagaccccgacctgcctgctgctgactccggagggcgccttccacagctttggctacaccgcccgcgattactaccatgacctggaccccgaagaggcgcgggactggctctacttcgagaagttcaagatgaagatccacagcgccacggatctcaccttgaagacccagctagaggcagtaaatggaaagacgatgcccgccctggaggtgttcgcccatgccctgcgcttcttcagggagcacgcccttcaggagctgagggagcagagcccatcgctgccagagaaggacactgtgcgctgggtgttgacggtgcctgccatctggaaacagccagccaagcagttcatgcgggaggctgcctacctggctggactagtgtcccgagagaatgcagagcagctactcatcgccctggagcccgaggccgcctcggtatactgccgcaagctgcgcctgcaccagctcctggacctgagtggccgggccccaggtggtgggcgcctgggtgagcgccgctccatcgactccagcttccgtcaggctcgggagcagctgcgaaggtcccgccacagccgcacgttcctggtggagtcaggcgtaggagagctgtgggcagagatgcaagcaggagaccgctacgtggtggccgactgcggcggaggcaccgtggacctgacggtgcaccagctggagcagccccatggcaccctcaaggagctctacaaggcatctgggggcccttatggcgcggtgggcgtggacctggccttcgagcagctgctgtgccgcatcttcggcgaggacttcatcgccaccttcaaaaggcaacggccggcagcctgggtagatctgaccatcgccttcgaggctcgcaagcgcactgctggcccacaccgtgcaggggcgctcaacatctcgctgcccttctccttcattgacttctaccgcaagcagcggggccacaacgtggagaccgctctgcgcaggagcagcgtgaacttcgtgaagtggtcctcacaggggatgctccgaatgtcttgtgaagccatgaacgagctctttcagcccaccgtcagcgggatcatccagcacatagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaaggggaa

SEQ ID NO: 139776 - DNA, 5722 bp, Homo sapiens
  Payload ID: 7412
  Gene Symbol: HSPA12A
  Gene Name: heat shock 70kDa protein 12A
  Uniprot ID: O43301
  ENST ID: ENST00000369209
  CDS Start-End: 106-2133
ggcggctcagacacggcccgagcgccgccgcggacgcggacagagacccgcacgggcacgggcgctgcgctggaggctcccctcgcggtccggggctgcgcgaccatggcggacaaggaggccggcggcagcgacgggccccgagaaacggctcccacatctgcatattcatctccagcccggagtcttggggacacaggaataacgcctctgtccccctcccatattgtgaacgacactgactccaacgtctcagaacagcagtcatttctcgtggtggtggccgtcgactttgggaccacatccagtggctatgcctacagcttcaccaaggagccggaatgcatccatgtgatgaggcgatgggagggaggtgaccctggtgtgtccaatcagaagactccaaccaccatcttgctgactcccgagaggaagttccacagcttcgggtatgccgccagggacttttaccatgacctggatcccaatgaggccaagcagtggctgtacctggagaagttcaagatgaagctgcacaccactggggacctcaccatggatacagacctgacggcagcaaatggcaagaaagtcaaagcccttgaaatctttgcttatgccctgcagtactttaaggagcaggcgctgaaggagctgagtgaccaggcgggttcggagttcgagaactctgatgtcagatgggtcatcacggtgcctgccatctggaagcagccggccaagcagttcatgagacaagctgcctaccaggcaggcctggcctcccccgagaactcggagcagctcatcattgccttggagcctgaggcagcctctatctactgccgaaagctgcggctacaccagatgattgagctgagcagcaaggcagccgtcaatgggtacagcggcagtgacacagtaggagctgggtttacacaggctaaggaacacatacggcgtaatcggcagagtcggacctttttggtggagaatgtcataggagaaatctggtccgagctggaggaaggtgataagtatgtggttgtggacagtggcggtggcaccgtagacctgacagtccatcagatccggttaccggagggacaccttaaggaactgtataaagcaacaggcggaccctatggatctttaggagtagattatgagttcgaaaaacttctgtataaaatatttggagaggattttattgaacaattcaaaatcaaacgccctgcagcctgggttgacttaatgattgcgtttgagtctcgcaaaagggcggctgccccagacagaactaacccgctgaacatcaccctgcccttctccttcattgactactacaagaagttccgcgggcacagtgtggagcacgccttgcggaaaagcaatgtggattttgtgaagtggtcctcgcaggggatgctgcggatgagtccagatgccatgaacgccctttttaagccgaccatcgatagcatcattgagcatctccgggacctgtttcagaagcccgaggtgtccaccgtcaagttcctctttctggtgggcggctttgccgaggcgcccctgctgcagcaggcggtgcaggctgcttttggggaccagtgccggatcatcatcccccaggacgtgggcctcaccatcctcaagggtgccgtcctctttggcctggaccccgcggtcatcaaggtgcgccggtcgccgctcacctacggggtaggcgtgctgaaccgctacgtggagggcaagcacccgcctgagaagctgctggtgaaggatggcactcggtggtgcaccgacgtctttgacaagttcatctctgccgaccagtctgtggctctgggtgagctggtcaagcgtagctacaccccggccaagccctcccagctggtcattgtcatcaacatctacagctctgagcacgacaacgtcagcttcatcactgatcccggggtgaagaagtgtggcacgctccgcctggatctcacagggaccagtggcactgcggtgcccgcccggagggagatccagacccttatgcagttcggggacaccgagatcaaagccacagccattgatatagccacttcgaagagtgtcaaagttgggatcgacttcttaaattactaaccctcccgccccgctgcctgtccccttggactcaacttatctgcatctgctgacctcaaccttgactgttctttccctaaccttgaccctcaccattgcccatgtgaatttcagcagggaagatgagaacaatcagggctagaaataattagtgacttttgagggcacactggagtcagaaaaacagaaattaagattaaggtttaggcatagaaaattaaaggatcctggaggagcagctagttttcataggtacaaaagtggtgaaatggccacggagaagggaatcagtacatttctgcagcagtggttgcgctgctttgaacagatctccgttatgtagaatttaggatgccctattgctgtctttctagatttaaaatgagatctttgaaccaggaggagatcttcatctgagacttgtctttctaaattttttggatggccatcaatataaaatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacctcacattcttagcaggtgaaaacttgccatgatggaaacagatagtgaagagttactgacgtatcccaaattatatgctgtgacataaattcccagcatgcccagccctgatttctgagttcataagtaattctagtgaaccttagtaggaattctgggtaagaaaatgaggttgccattggtcttgtttgcatcaccaagaccagacatccagaagagcccctcaccttgaaaagcagacagattttaaattaaccccctccttcccactcaccttcatctccctaagagttttggccatttaattccacattttgaaaggaatacattggtgaaatttgggaagagaatctgtgctatgcaatgtttcattaaaatcttcagtttttcaagtctctctaaaaataatttgtagatctatacttgatgtattaagtcagttttttttcacagcgggcctgtggctcgcctgcatcagaattgcctgggtgcgtgttcagaacaggttcctggatctgagccctttttaactgaggccgactcttggagaggggcaccagaatctgcatttgtagtgtataccacatcgtggttcaactgaaattggagaaatactaacctgagattttgttgaagttcacacacagatcacagcccgccctctgcaggtgtcccctttgggctcctttaggaagagggcttccatgagaaggtgaccccataccttgccctcttggtcaatgggattggggctccacctggcttggagatggcccttttaaccctcacaggaagggccaggggaggaaaaaaattgcaagaaagcgacaccaagaacggagctgactgaggaaccaactggagggtcttcactctctccttccccagtgtacaaaaccagttttctgcaacattcaggagccaaatgaggaaaaagaatcaagaatctgactcacagcccatctgatctgttcaaagctgtcttttccacctgctgaaattcattaaatcactggaggcatgcataatgaatggagaatgagtgaacttccaatgcaacttggattcacaaacccattatcatagccaatatgcagattttaaacagcatttcacatttcatttgaccatgtcttctttttcgcatcgcctgctgcagaattccctactagaatgtgaaacaacgaacaaaccacagaacttagagtgtgctggttagtcacataacttagtagcaggattgtgtatccaggcacaaaggtgtctttgctaatgttctcttgctacctgccctgcttcaaacgctaaatggtatgggtctttctttgttgccagccatattctacaaataagacttttcaatatagttatgagtaatataattttatgtacatataatgttagaatattgtacagaatcttggtttctacgatgcgcttttcttgtttcaaaaagaggaaaatgcttgatttttgttgatgatacttttgttactgtccttaattttccatagtttggtttcttaattgtgctcactaagcatcgatctgtgctgatgccaagctatggactatgtacgcaagaccgagcaatagacagaggtgcctagggtccaaacacactgaacgcacgtggaccgcctggatcaggagcctcatcagacccttctccatgcacatccttcccaaacagtcacagattccattgaaaggagcagattctatcagttcttctgtgcagactttaagagctgaacgttctggttctggaagccatgtgactgcgcagaacaacctaagaaaccctttgtgtcctgaggggtcgttgacctctccttccgggtcggagcagtcactctgagggcaaagcgtggtccactgtgtgtgatgttttcaggatgctagggtcaaagaaagaaaccaagtggtacataagcccagcttttctgctgggctaagtgtaagtgtgagtaacatggtcaagcccctcttttttgggctaatgtaaagcctttcctgccttgcattaatgctatctccctgtgtactgtttctcttaaatgagcagatagaaatctgcagtgttggcagataggtgatggagaggatgataattttatcttctggccacagagctgcagccccagttgtcagagtccttaaatgaaacccccaaatccatccctccttccctacccccactggaatattctagaataagagcactggataagtacacttgaacacatttttctaaccttagaaaatacctacaaggcctgttgtcttgacccattactcaattgtccctggcatattatctgatcttcacgtttcttggaagcagaatcatcaaggctttcctttgtaactgccctttccgtacacagcaggcatgaataaatgctgagtaacagacaagttacagacaggaggggaaagaggaggaaccatacaactgtttttgcaaaatgatggctgagtccagattatagaggttgccttacccttagaatgttatttagaccaagtttagcttttagagtccaggtctggttaattgccagggtagcaaagaatcgcatgcaccaatgtaaacaggagtcagaatgcattattagtcaaagatcgaatttcacattgtagagatgtatagctgtgattaagctgcatatgtatgctgggaaacggcttgagtggatggctaatataaaagttgttggccataatgccacacctctcatctgcttgaaatatggaccagtattctaaaatatcagctactggggtctcattcactacaagataaattcaaacttcacagaactttgcagcagttcaccaccagacgggactgtgtctgcaaactctcttgtcttcacagacgcctaataaagcaaaactctgaatctca

SEQ ID NO: 139777 - DNA, 624 bp, Homo sapiens
  Payload ID: 7412
  Gene Symbol: HSPA12A
  Gene Name: heat shock 70kDa protein 12A
  ENST ID: ENST00000480802
  CDS Start-End: 1-360
gagctgagtgaccaggcgggttcggagttcgagaactctgatgtcagatgggtcatcacggtgcctgccatctggaagcagccggccaagcagttcatgagacaagctgcctaccaggcaggcctggcctcccccgagaactcggagcagctcatcattgccttggagcctgaggcagcctctatctactgccgaaagctgcggctacaccagatgattgagctgagcagcaaggcagccgtcaatgggtacagcggcagtgacacagtaggagctgggtttacacagggtacctctgctctctctctccccctcctgctctccttccttcccaagccctggatgtctctctccctctgatgattttaaaggcacttagtgccataatgaagaatcaggatactccgggaggaggtgggctttaagcacctctctgctcagcccccctacctggcccctccaaggacccccataaatggaggcatggttaccctggttcatcacccaccaagtgtctgggggcggggagcttctctctaagaatctgagggtagcctgagagcggttattggcctcacattgtactaggctcttaatctttcttgtgtattaacagattcttaa

SEQ ID NO: 139778 - DNA, 596 bp, Homo sapiens
  Payload ID: 7412
  Gene Symbol: HSPA12A
  Gene Name: heat shock 70kDa protein 12A
  ENST ID: ENST00000468935
  CDS Start-End: 188-596
tgcccggccttcgtctctgcggtgggagcacgcagtcttcactcagcttctctgtgccctgccagccctaggcagcaggcagggagagcactgtagcgcgttccaatgccggccagggagagtgttttttctcccggggggcccattcctggggcagagccactggctctgggaagacttcagaaaaatgctaggcctgaatgatgaaacggctcccacatctgcatattcatctccagcccggagtcttggggacacaggaataacgcctctgtccccctcccatattgtgaacgacactgactccaacgtctcagaacagcagtcatttctcgtggtggtggccgtcgactttgggaccacatccagtggctatgcctacagcttcaccaaggagccggaatgcatccatgtgatgaggcgatgggagggaggtgaccctggtgtgtccaatcagaagactccaaccaccatcttgctgactcccgagaggaagttccacagcttcgggtatgccgccagggacttttaccatgacctggatcccaatgaggccaagcagtggctgtacctggagaagttcaagatgaagctgc

SEQ ID NO: 139779 - DNA, 1904 bp, Homo sapiens
  Payload ID: 7413
  Gene Symbol: HSPA14
  Gene Name: heat shock 70kDa protein 14
  Uniprot ID: Q0VDF9
  ENST ID: ENST00000378372
  CDS Start-End: 240-1769
gcactgtgcagtttccgcggagcgcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaa

SEQ ID NO: 139780 - DNA, 1689 bp, Homo sapiens
  Payload ID: 7413
  Gene Symbol: HSPA14
  Gene Name: heat shock 70kDa protein 14
  ENST ID: ENST00000437161
  CDS Start-End: 102-533
gaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagaggcaactggtgcttttcagctaggccttgaaaaattgcttcagaggttgatttcgaataccaaaagctaggaaccaattacaaaaggctctgcttcctaaactggtagaagtctagttcccaaacctgccttctgaatccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattc

SEQ ID NO: 139781 - DNA, 578 bp, Homo sapiens
  Payload ID: 7413
  Gene Symbol: HSPA14
  Gene Name: heat shock 70kDa protein 14
  ENST ID: ENST00000441647
  CDS Start-End: 1-386
cagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaaggagcttattctccatggagtcagtctaattcagaagatggttgatactgaagcctaagagccaggctgtttggaaagctaattctgtgtccaaatatatcaccaaaaccacaagaagtgctgcatgatttcagagcgcagagaagaaaattgacacgggggcggggtgggcaagcaagtgtattgggaaatatgttaagtgagatctttgtcataaattaataaacctcagaaagt

SEQ ID NO: 139782 - DNA, 2483 bp, Homo sapiens
  Payload ID: 7414
  Gene Symbol: HSPA1A
  Gene Name: heat shock 70kDa protein 1A
  Uniprot ID: P0DMV8
  ENST ID: ENST00000375651
  CDS Start-End: 294-2219
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139783 - DNA, 1909 bp, Homo sapiens
  Payload ID: 7414
  Gene Symbol: HSPA1A
  Gene Name: heat shock 70kDa protein 1A
  ENST ID: ENST00000383389
  CDS Start-End: 215-1645
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139784 - DNA, 2483 bp, Homo sapiens
  Payload ID: 7414
  Gene Symbol: HSPA1A
  Gene Name: heat shock 70kDa protein 1A
  Uniprot ID: P0DMV8
  ENST ID: ENST00000400040
  CDS Start-End: 294-2219
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139785 - DNA, 1909 bp, Homo sapiens
  Payload ID: 7414
  Gene Symbol: HSPA1A
  Gene Name: heat shock 70kDa protein 1A
  ENST ID: ENST00000452298
  CDS Start-End: 215-1645
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139786 - DNA, 2483 bp, Homo sapiens
  Payload ID: 7414
  Gene Symbol: HSPA1A
  Gene Name: heat shock 70kDa protein 1A
  Uniprot ID: P0DMV8
  ENST ID: ENST00000430065
  CDS Start-End: 294-2219
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139787 - DNA, 2483 bp, Homo sapiens
  Payload ID: 7414
  Gene Symbol: HSPA1A
  Gene Name: heat shock 70kDa protein 1A
  Uniprot ID: P0DMV8
  ENST ID: ENST00000441618
  CDS Start-End: 294-2219
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139788 - DNA, 2483 bp, Homo sapiens
  Payload ID: 7414
  Gene Symbol: HSPA1A
  Gene Name: heat shock 70kDa protein 1A
  Uniprot ID: P0DMV8
  ENST ID: ENST00000433487
  CDS Start-End: 294-2219
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139789 - DNA, 1909 bp, Homo sapiens; identical to SEQ ID NO: 139783
  Payload ID: 7414
  Gene Symbol: HSPA1A
  Gene Name: heat shock 70kDa protein 1A
  ENST ID: ENST00000449876
  CDS Start-End: 215-1645

SEQ ID NO: 139790 - DNA, 1909 bp, Homo sapiens
  Payload ID: 7414
  Gene Symbol: HSPA1A
  Gene Name: heat shock 70kDa protein 1A
  ENST ID: ENST00000422919
  CDS Start-End: 215-1645
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 139791 - DNA, 1909 bp, Homo sapiens; identical to SEQ ID NO: 139785
  Payload ID: 7414
  Gene Symbol: HSPA1A
  Gene Name: heat shock 70kDa protein 1A
  ENST ID: ENST00000608703
  CDS Start-End: 215-1645

SEQ ID NO: 139792 - DNA, 2521 bp, Homo sapiens
  Payload ID: 7415
  Gene Symbol: HSPA1B
  Gene Name: heat shock 70kDa protein 1B
  Uniprot ID: P0DMV9
  ENST ID: ENST00000375650
  CDS Start-End: 217-2142
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttt

SEQ ID NO: 139793 - DNA, 2524 bp, Homo sapiens
  Payload ID: 7415
  Gene Symbol: HSPA1B
  Gene Name: heat shock 70kDa protein 1B
  Uniprot ID: P0DMV9
  ENST ID: ENST00000391548
  CDS Start-End: 217-2142
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttgcttggcgaaaacactacaaaggctgggaatgtatgtttttataatttgtttatttaaatatgaaaaataaaatgttaaactttt

SEQ ID NO: 139794 - DNA, 2525 bp, Homo sapiens
  Payload ID: 7415
  Gene Symbol: HSPA1B
  Gene Name: heat shock 70kDa protein 1B
  Uniprot ID: P0DMV9
  ENST ID: ENST00000391555
  CDS Start-End: 217-2142
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttttttttttttttttttttttttttttttgcttggcgaaaacactacaaaggctgggaatgtatgtttttataatttgtttatttaaatatgaaaaataaaatgttaaactttt

SEQ ID NO: 139795 - DNA, 1929 bp, Homo sapiens
  Payload ID: 7415
  Gene Symbol: HSPA1B
  Gene Name: heat shock 70kDa protein 1B
  ENST ID: ENST00000417199
  CDS Start-End: 1-1929
ggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattag

SEQ ID NO: 139796 - DNA, 2515 bp, Homo sapiens
  Payload ID: 7415
  Gene Symbol: HSPA1B
  Gene Name: heat shock 70kDa protein 1B
  Uniprot ID: P0DMV9
  ENST ID: ENST00000450744
  CDS Start-End: 217-2142
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgttttttttttttttttttttttgcttggcgaaaacactacaaaggctgggaatgtatgtttttataatttgtttatttaaatatgaaaaataaaatgttaaactttt

SEQ ID NO: 139797 - DNA, 2348 bp, Homo sapiens
  Payload ID: 7415
  Gene Symbol: HSPA1B
  Gene Name: heat shock 70kDa protein 1B
  ENST ID: ENST00000458062
  CDS Start-End: 38-1966
ccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttttttttttttttttttttttttttttttgcttggcgaaaacactacaaaggctgggaatgtatgtttttataatttgtttatttaaatatgaaaaataaaatgttaaacttt

SEQ ID NO: 139798 - DNA, 2521 bp, Homo sapiens
  Payload ID: 7415
  Gene Symbol: HSPA1B
  Gene Name: heat shock 70kDa protein 1B
  Uniprot ID: P0DMV9
  ENST ID: ENST00000445736
  CDS Start-End: 217-2142
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttt

SEQ ID NO: 139799 - DNA, 2347 bp, Homo sapiens
  Payload ID: 7415
  Gene Symbol: HSPA1B
  Gene Name: heat shock 70kDa protein 1B
  ENST ID: ENST00000545241
  CDS Start-End: 38-1966
ccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttgcttggcgaaaacactacaaaggctgggaatgtatgtttttataatttgtttatttaaatatgaaaaataaaatgttaaacttt

SEQ ID NO: 139800 - DNA, 2544 bp, Homo sapiens
  Payload ID: 7416
  Gene Symbol: HSPA1L
  Gene Name: heat shock 70kDa protein 1-like
  Uniprot ID: P34931
  ENST ID: ENST00000375654
  CDS Start-End: 191-2116
gggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccacggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagta

SEQ ID NO: 139801 - DNA, 2544 bp, Homo sapiens
  Payload ID: 7416
  Gene Symbol: HSPA1L
  Gene Name: heat shock 70kDa protein 1-like
  Uniprot ID: P34931
  ENST ID: ENST00000383390
  CDS Start-End: 191-2116
gggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagta

SEQ ID NO: 139802 - DNA, 2544 bp, Homo sapiens; identical to SEQ ID NO: 139800
  Payload ID: 7416
  Gene Symbol: HSPA1L
  Gene Name: heat shock 70kDa protein 1-like
  Uniprot ID: P34931
  ENST ID: ENST00000417601
  CDS Start-End: 191-2116

SEQ ID NO: 139803 - DNA, 2544 bp, Homo sapiens; identical to SEQ ID NO: 139801
  Payload ID: 7416
  Gene Symbol: HSPA1L
  Gene Name: heat shock 70kDa protein 1-like
  Uniprot ID: P34931
  ENST ID: ENST00000456772
  CDS Start-End: 191-2116

SEQ ID NO: 139804 - DNA, 2544 bp, Homo sapiens
  Payload ID: 7416
  Gene Symbol: HSPA1L
  Gene Name: heat shock 70kDa protein 1-like
  ENST ID: ENST00000426095
  CDS Start-End: 191-2116
gggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattgaagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagta

SEQ ID NO: 139805 - DNA, 2767 bp, Homo sapiens
  Payload ID: 7417
  Gene Symbol: HSPA2
  Gene Name: heat shock 70kDa protein 2
  Uniprot ID: P54652
  ENST ID: ENST00000247207
  CDS Start-End: 383-2302
ccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctc

SEQ ID NO: 139806 - DNA, 5400 bp, Homo sapiens
  Payload ID: 7417
  Gene Symbol: HSPA2
  Gene Name: heat shock 70kDa protein 2
  Uniprot ID: P54652
  ENST ID: ENST00000394709
  CDS Start-End: 77-1996
ctctcttgcctgccgccatgtgcctttcgccttctgccgtgattgtgaggcctccccagccatatggaagttcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaagttactgtcttggagttttcaattttccttcctttatattttacccatattcgtcttttaagatgttagtatgatgtgaaatttatctaaccaatcttgtttaattcccagatgagggtgctgccttgaattccaacaacttaaggggagaagaatctgggtaaacttcacccacccttaaatacagaaacctgacttggggtcttcctagtgtactcacactcctacaacttaagtgtccaaatgaaaattcacctgaatattccaggaaaatatgagctatattctggggttaaatgtaaaatgagcctttaacaaaagctgggcagaagttgtcttataattgccaaaggaaatatggaaacaaattaattttgtgacatacaggagcctgaaacaagagacagcaggcaagctttcaagtgacttaatagtgagtataaatttagtcaaacttgtttaattttctagtaaaacagctcaacttctgagcttatggcaaattctaataacatgtttcccgcagttagaattacttgggtagggaaacataattattattatttttttctggtttggggatcataacgtttttgcaatacttgccttaaatcactacgatagatttcttttttaaaaggcaaactgtactagatagtcttgtattttgttaatatacaacttgtccattttcctccatatccaatttgagattgttatagataagaatattgcaaccctttggtgatccactatcctggacttaatctttaaaattcacatccttcagagaaaggaattcatttttattttttagtgaaatgacatgactactcttttcttactctctttaaggagaacttgagagaaattcagtaaaaccaataggaaaatgcatagttaacctaatgtttttactgcacatagacgttttgatatctttccacatgatgcaggtttgcttcatgctgctcataagacaatagttatgaaagctttatcttcaatttagtagtggacccatctgtgtcattcagagagattaattttatgaataatggaatgagtaataattttaaaactagctaagaagttagcctaagaatactggcctttggtaatgaccctttcatacaagagttgactcttaagtacacataaggtgtttttttttttttcctttttagcaagcctcatttgggtaggggggaggaagataaatagccaacagtgaaattgcttcaacataaaaacctttttttttttttaaaggaaactgctttttatactctgaaaagctaaagataactccaatttatcagtgctggtgtcacattggtggaaatttttcagcaatgagcatttaagggtgtttcatggactacaggcataaatatgtgacaaactactatggtactacaaaatcaggttaattgtagctttagagtgacgtttactgtgagttttaccaagataatacccattctgttacccttttattagtcctttatttgttgaaagtgttcattccttgctctaacttcaaaatataatggagtccttctgtaaatgcagtttggtatgactcattttagacctcacttaagagattagtttctaaagtatcagaaaatgaccattggtagtttttgatcctacggcctgacctccggtagcttgctataatactaacatcaatctgggcagatacttcattttctattttgaaaagtaatttgtaaaactcaaattcttgagttttacattcttgagcattcttgagagtgtttcttatttaattctctcttttcaaatttaccaagatttgcatattaccaagataaagccaccaaagtagccattcactttccaggggtcagttgaaacttgtaacctgataactcctgggaactccttagcagatgttagatcagccatagtcaaataacagtggaaaaagtacttgatgttaggatggggctaaattacagtttaaggattctccgacaggcacttatctgaaattctttttttttttttttttttgagacggaatttcactcttgttgcccaggctggagtgcaatggcttgatctcggctcacttcaacctccgcctcctgggttcaagcgattctcctgcctcagcctaccgagtagctgggattacaggcatgcaccaccacacctggctaattttgtatttttagtagagatggggtttctccatgtttgtcaggctggtctggaactcccgacctcaggtgatccgcccgccttggcctccccaagtgctgggattacaggcgtgagccacgcgccagcccacttacctgaaattcttatctgaatgtttgattaacatagttgtccctgttttgagggaacaaatatagacacctgtcaaacgaagacataactagttgtttacagtatttgagatgtgtgaaatttcaaaacaaactcactttaaattttttatagtattgatttgatatgtataatgaaaatgcattaaaacttgtacattaggagatcttagtacaatttacaactgttaatttaacatgtatgtgtaatattatgttacccattcaatatgtaatggagacttaatgagtatttcttttttatgtataatcttaaacagtaatacaacctggctatctagatgaaatcagaaaatctatttttatgattttccaatagtggacctataacatattcttacttttaactgaatgtagtttataaaggttgtgttgtgaggcatgctcctcttgcttttgaacacgatttaaattgaagtttaaaaatatctcacatccgtatgtctcaactgttaagggaatatatatgtttggattcagaagcaggaatattcaattgtgtaatgtataaataggtgtgaataaacttctgaattagttacagaa

SEQ ID NO: 139807 - DNA, 4825 bp, Homo sapiens
  Payload ID: 7418
  Gene Symbol: HSPA4
  Gene Name: heat shock 70kDa protein 4
  Uniprot ID: P34932
  ENST ID: ENST00000304858
  CDS Start-End: 290-2812
ctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaaaaaattttttttttttttttttttttttttttttttttttttggtgtgtgtgtgtgtgtgtgtggggaagggtgtgggtgctgggatgggggtgaatttcaagttgaaacacgatgatgtggtctgcttgctctctgcttagacaggctttaagaccaattggattttcatggaggccaggacagagagtggtaattgatggcttgtgtacagacaagcatttatccaggttgcgttatccaaactgatttgttaaagctccaggtcacgttcttacactaagaaaatcattcagtaaacatgagacaagtttaggaaaaactaataaaataaacctgtcttaaacttgaa

SEQ ID NO: 139808 - DNA, 2204 bp, Homo sapiens
  Payload ID: 7418
  Gene Symbol: HSPA4
  Gene Name: heat shock 70kDa protein 4
  ENST ID: ENST00000615899
  CDS Start-End: 11-1438
agccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcgttcttttgtctctcgtatgtccctagctcagttttcagttcagaaagtcctcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggt

SEQ ID NO: 139809 - DNA, 728 bp, Homo sapiens
  Payload ID: 7418
  Gene Symbol: HSPA4
  Gene Name: heat shock 70kDa protein 4
  Uniprot ID: P34932
  ENST ID: ENST00000617819
  CDS Start-End: 282-728
gctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcaaaatggaccagtggatggacaaggagacaacccaggcccccaggctgctgagcagggtacagacacagctgtgccttcggattcagacaagaagcttcctgaaatggacattgattga

SEQ ID NO: 139810 - DNA, 2358 bp, Homo sapiens
  Payload ID: 7418
  Gene Symbol: HSPA4
  Gene Name: heat shock 70kDa protein 4
  ENST ID: ENST00000617074
  CDS Start-End: 124-2223
caccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagaaggcaaaagtgaagaccagtactgtggacctgccaatcgagaatcagctatttggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataaca

SEQ ID NO: 139811 - DNA, 10790 bp, Homo sapiens
  Payload ID: 7419
  Gene Symbol: HSPA4L
  Gene Name: heat shock 70kDa protein 4-like
  Uniprot ID: O95757
  ENST ID: ENST00000296464
  CDS Start-End: 412-2931
ttttccagatctttctcgaacccgcagcttcttgggcagccgttgcccgagtgctgacggaagcggccgaagtccgggcccggagctggctcgggcgcggagcggaggctcgcgcgcctcccgggcagccgagcgcgcaggcgcaggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttctcaacaaattagtccatctcattgatgtaccacagaaatccaaagctttgctgtcatcacataaatgaattaaatcacatgtgaaagggaacacacccaattttatgttaaggtgaaaccagcagtttgcttcttttattagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaacttaagatgtattttaaggactttatctgtgcttcatcacccaacttgttcacattgttaatttctgtccagagacctgaaactgcttaagtatgggaacagactgaaatggtgtttcaacctgcaagagacagaagcatagacaagtatatgagcccttatgtccttaatgccaatcaactagattgacctaggttaaaatttcaaaaggctcattttctcccaaagctaaatctttatattaggaacaattaaatattgacttaagttgtaaaaattgagagtacaatatctttagggatagtcattatttctcacaactagttctctacgagagattttgtttctacaatgtagtcagcacttaatggagagtatggagtagtgcattttgcagggatttttattccgtcttttgaggggaagaatctcttttttgcattaaaaaatcatataaacttaatatatttttaaactctcctagtctttaaactttctcttaattctcttaaaatgaaataggtatatccaataggtgatgaaatacattttttacaaacatagatgctttttatttgtatgttgaatgtacagattcatttcaagaaaagcatgaagataatgaaagcaaatatgtaacaatacaagtagggactttagagcttctatttgggttaaaacatccactcacttggttaggagctatgcctcagaaacttcctgggagtaaatatgggaacaacttttctattaatacatctaaattttctagtatatcctgacattttccattcctgctctgaagtcacttttagttttgtgttttagtcagatagtaccactaatttttgtaattatataacacttcatttaataacttatatacatccaaatatatatactttttctacccaattattcaacttaaaagatttcaaaaacgatttagccttataatgtatttatttatttaattcattaatgaaagagagtgctctctttaatgcagctttgggtagacagtctaattcagtccaattttaatctgcattaaaatatgcaatgctagacaaagattttcaaaataaaaagctattatttcagaaattattttaaaagatgcatagtaaaacagtgttttcctatggtaagcaaataagaatgaagtttgtagggaatatttggaatgattaatataaattagtatactttggctctgtggaaaagtgtaaattgtggttttagaaaccaactcttgatagttgtactgtgattataaaaaacaattgttaaataatataatggaagtttgtgataattccttagcagtaatgtaaaattattaagttttggccaggcgctgtggctcacgcctgtaatcctagcactttgggaggccaaggcaggcagatcacctgaggtcaggagttcaagaccagcctggccaacatggtgaaaccctgtctctactaaaaatacaaaaaagtagccgggcgtggtggcatgtccctgtaatctcagctacccgggaggctcaggcaggagaatcgctggaacccaggaggcagaggctgccgttagctgagatcgtgctcctgcactccagcctgggcaacagaacaagactccgtctcaaaaaaaaaacaaaaattcttccaaaaaactagaaagagcacagcaaagaatttggctattgaaataacagataaacttgattttgaaaaggataacaaggctgggcacagtgactcacacctgtaatcctagcactttgagaggctaagaagggaggatcacttgaacccaggagttcaagaccagcctgagaaacatagtgagaccctgtctctaaaaaaataaaaacttagcaaggcatggtggtgcacacctgtagtcctagctactcaggaggctgaggtggaggatcacttaagcctgagaggtcaaggttgcaatgagccataatcataccactgcactccagcctgggcaacagagtgaggccctgtctcaaacacataaaaggcagtggcccacgcctgtaatcccagcactttgggaggccaaggcgggcagatcacgaggtcaggagatcaagaccatcctggctaacacggtgaaaccccgtctctactaaaaatacaaaaaattagctgggcatggtggcgggcgccggtagtcccagctactcaggaggctgaggcaggagaatggtgtgaacccaggaggcggaggttgcagtgagccgagatcgcgccactgcactccagcctgggcaacagagcaagactccatctcaaaaacaaaacaaaacaaaaacataaaaggaaaacaagacatttactaagaagagctaaaggaaagaattaaaggtttcttatgcttttttgggggggggtgtcaatttttagtatattaagagctaaaagaagtaaaggtttcttagactttttttgggagggaggcgtcaatttttagtatatttgtgattaattccatgatagaagtctttaaagagaattttggggctcaataatttaacataatgtcagtgttaaagcacttaatccaaattagcccatctttaactgttttgaaaaatctatatttattaaaggtagtagacatttgaatatagtaatcaaattaactgattttgttttcaccctaaatacatacaaccattcctccactttcataaatttgacaaataataagcctctcccattaggattttctgttttatagtaaatagttggtatttggtagtccacaattaaagtcattgcattaattttacaaattatagatttagaaatgattcttaagttattggtaaaatataactttctcagtttttaaaagtttacaaaatttttttttttgttttgagacagagtatggctttgttacccaggctggattgcaatggggtgatctaggctcactgcagcctccaccacctgagttcaagcgatttttctgcctcaacctctcctgagtagctgggactacaggtgcatgacaccacacccagctaatttttgtatttttatagagatggagttttgccatgttggccagcctggtcttgaactcttgaactcctgacctcaggtaatccacccacctcagactcccaaagtgctgggattacaggcgtgagccaccatacccggccaaaaatttttgcttttaaagttaatgttattttgtggttaaacttctaaagttttgaactgtaagcagaattttgttttgtgatattttattgtataaactgttaatgagaggcacagctaattgtacatatcaatatacatttaaaatctggtaacactggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgcagatcaaagaccaaggcttgtaaccaaaacaagcaaaaagaaactttagctgtttaactatcacctctctaatttaaaatgcatgaaaattaatactttgtttttgttttttttttggaaacagtctcactctgtcacccaggctggagggcacaatctctgctcactgcaacctccacctcctgggctcaagcctcaagcaattctcctgcctcagcctcccaagtagctgggattacaggaacccaccaccacgcccagctaatttttgtatttttagtagatggggtttcatcatgttggccaggctggttttgaactcctgacttcaaatgatccacccacatccacctgccagagtgctgagattacaggcgtgagccaccgcacctggccaatgttcttttatatactcatgttttctaacaaaacagctttggatttataatgctgccagatgtcattacaattttttttctaaattcaaaggtaattattctaaacaataaaagggcacctggaattttcagaacattaaaaaactgaaaccacttagaagaaaagaagaaacctaaatgtctgtggaagtgatcagtattaagtgggtgatggctctttcatcttccttatccctaaagatacttccaacatattgttagagtaagtattaaaagaaaaagtaggtttgctgaaaaacattactaaatgacttggagctctccagtcaaagaaacaaagctaattgaaataatgtacatttggttcagtctgtcaggcaagtacaaatccataacaaaaaaaattaatagtatgctctttgctttggaatctctaatttacggtcatgccctaagtcacaggatgattattagggaaatgtcattgacacctgaaaattacctatcctgtaaaaagactggtgaaattcaacatgttttaaataatttaattgcattatagcatataaactataaatgaaaatgatctttgtctttcctttatcttgctttatcctcttatccaattctagactcttaaataatcactgtatttttctcaagtatttgttattttttattatcctttagatctttttgttcatggctctttaaaaatagttttactgataatccaatcacttggatagttaattttattactttttgtttcctttttaatatttattcttcccgttaagggttttttggctataaattcgtacttgataagctatgttatttctttgtgtaatttaatagtagcattctggagtagattctttttttgtattctggccttggaatactttaattccggaccaaaagaggtcaattttgtgagtattgcctattaagtaaacaacatccctcatttttaatccaaatatcaatttgacagaataacaagggtcagaaattcaaaatagctgttagacacctttgattctttgctgctctctggttatgtatgtgtgttgtgcatcttccttgttgttttagagtttcctaaattttttgcttctggggacttgagtatttttaaatgttcttaaaattatatgaatctacccagaatgtagatgtcaaaatgtaattagaggccccgtgcagtggctcacgcctgtaatcccagcactttgggaggccgaggcaggtggatcgcctgagctcaggagttcaagaccagcctgggcaacatggcaaaaccccgtctctactaaaaatacaaaaaattagctgggtgtggtggtgtgtgcctgtagtcccagctactcgggaggctgaggcaggagaatcgcttgaaccctggcgaaaccccatttctaaaatagaaaaatttagccgggtgtggtggtgtgtgcctatagtcccagctattcgggaggctgaggcaagagaattgcttgaacccgggaggtggaggtcgcagtgagctgagatcctgccactgcactccaacctgggggtaacagagcgagactctgtctcaaaaaaaaaaaaaagtgtaattagaaatggaaatctaggtaaaggaagctttaaaatgttgtattttttccctgaaataaacttttatgatttaatgtcttggaaaaagactcacatgaaaagtggcttttatatttggtaggataaagccattgtcctttaataccatagcaaatagaagcaatttttaatgaggttactgaattgtttagtattcctaatatggcatccaggtcatcttttcttttctccaaccattattaaaataacttgacactttgggaggccaagctgggcagatcacctgaggtcaggagtttgagaccagcctggccaacatggtgaaaccccatctctactaaaaaaaatacaaaaattagcggggccatggtgacgtgcacctgtaatcccagctactcgggaggctgaggtgggagaatagcttgaacctgggaggcagaggttgtggtgagccaagatcacgccactgcactccagcctgggtgacagagcaagactccatctcaagaaaaaaataaataaataataatttgtgtatgtgatgactgactctagtcattatggaaaataacttttggcagtttagttcctaatgttaacaattcctctttttaagagaggtactacatttgatttctcaatttctcagtttgttttcaatacaaacagcaaccactgaaatgcagaaaatggtaatcaagtgtgatgtttctataaaaataattgagattcacatgtaatagaccctttagctttaatgagcagacatgagaatggtttatgatcttaagttggtaacataggaatatgtatttgtcaattttagttcacaaacatatccataagaatgtttacacatggcagtatcaaagcatataaaatattttctatgtaagtaaattgcatctttatgctagtgaacaaagtagcaataaatgttcatttttggatggcagtacacattgttaacaatcgtgtaattataataaatatgtctacctactccttgaaccatgaa

SEQ ID NO: 139812 - DNA, 3020 bp, Homo sapiens
  Payload ID: 7419
  Gene Symbol: HSPA4L
  Gene Name: heat shock 70kDa protein 4-like
  Uniprot ID: O95757
  ENST ID: ENST00000508776
  CDS Start-End: 333-2852
atgggcccctcggggaggcgaggcctgcgggcgagcccttctgagggcagggggtgagggggcggcgcccgccagccaggacagcatcctgccgccgtgacaagcacgcctccggttgccaaaacaacccaaaaatgtgcctcaaaacacgttcgcaaagccccgggccggccggtcgcctgcctctcacctagcccgaccgcccgacgtcctactgccgagcgagggcgagcaagccaatgagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcattt

SEQ ID NO: 139813 - DNA, 2639 bp, Homo sapiens
  Payload ID: 7419
  Gene Symbol: HSPA4L
  Gene Name: heat shock 70kDa protein 4-like
  ENST ID: ENST00000505726
  CDS Start-End: 104-2545
aagtttgttggcaaggaatataatgaagtaattctgaaatatgaaaaactagttgctgcttataggctgctgttactggtaattttatgaggaaaccaactgtatgaaacctatattactttttatggaaagggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttc

SEQ ID NO: 139814 - DNA, 1822 bp, Homo sapiens
  Payload ID: 7419
  Gene Symbol: HSPA4L
  Gene Name: heat shock 70kDa protein 4-like
  ENST ID: ENST00000508549
  CDS Start-End: 230-1822
agtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaagattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacactt

SEQ ID NO: 139815 - DNA, 3908 bp, Homo sapiens
  Payload ID: 7420
  Gene Symbol: HSPA5
  Gene Name: heat shock 70kDa protein 5 (glucose-regulated protein, 78kDa)
  Uniprot ID: P11021
  ENST ID: ENST00000324460
  CDS Start-End: 205-2169
acagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaa

SEQ ID NO: 139816 - DNA, 2371 bp, Homo sapiens
  Payload ID: 7421
  Gene Symbol: HSPA6
  Gene Name: heat shock 70kDa protein 6 (HSP70B')
  Uniprot ID: P17066
  ENST ID: ENST00000309758
  CDS Start-End: 120-2051
agatccgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccacacgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacttttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttgcggggagggcggttcatcctcttctgcttcaaataaaaagtcattaatttattaaaacttgtgtggcactttaacattgctttcacctatattttgtgtactttgttacttgcatgtatgaattttgttatgtaaaatatagttatagacctaaataagcttttaaaactc

SEQ ID NO: 139817 - DNA, 2186 bp, Homo sapiens
  Payload ID: 7422
  Gene Symbol: HSPA8
  Gene Name: heat shock 70kDa protein 8
  Uniprot ID: P11142
  ENST ID: ENST00000227378
  CDS Start-End: 9-1949
cagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggca

SEQ ID NO: 139818 - DNA, 2004 bp, Homo sapiens
  Payload ID: 7422
  Gene Symbol: HSPA8
  Gene Name: heat shock 70kDa protein 8
  Uniprot ID: P11142
  ENST ID: ENST00000453788
  CDS Start-End: 278-1759
atcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 139819 - DNA, 588 bp, Homo sapiens
  Payload ID: 7422
  Gene Symbol: HSPA8
  Gene Name: heat shock 70kDa protein 8
  ENST ID: ENST00000534567
  CDS Start-End: 38-588
agttctggacctcgcgcgtgcttagacaggagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacgg

SEQ ID NO: 139820 - DNA, 2463 bp, Homo sapiens
  Payload ID: 7422
  Gene Symbol: HSPA8
  Gene Name: heat shock 70kDa protein 8
  Uniprot ID: P11142
  ENST ID: ENST00000534624
  CDS Start-End: 278-2218
atcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 139821 - DNA, 1112 bp, Homo sapiens
  Payload ID: 7422
  Gene Symbol: HSPA8
  Gene Name: heat shock 70kDa protein 8
  ENST ID: ENST00000528292
  CDS Start-End: 176-1112
gcctgcagctcttgggttttttgtggcttccttcgttattggagccaggcctacaccccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtg

SEQ ID NO: 139822 - DNA, 1884 bp, Homo sapiens
  Payload ID: 7422
  Gene Symbol: HSPA8
  Gene Name: heat shock 70kDa protein 8
  ENST ID: ENST00000534319
  CDS Start-End: 416-1648
tacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggc

SEQ ID NO: 139823 - DNA, 1924 bp, Homo sapiens
  Payload ID: 7422
  Gene Symbol: HSPA8
  Gene Name: heat shock 70kDa protein 8
  ENST ID: ENST00000526110
  CDS Start-End: 8-1891
agcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccaca

SEQ ID NO: 139824 - DNA, 674 bp, Homo sapiens
  Payload ID: 7422
  Gene Symbol: HSPA8
  Gene Name: heat shock 70kDa protein 8
  ENST ID: ENST00000532182
  CDS Start-End: 160-674
gtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaat

SEQ ID NO: 139825 - DNA, 536 bp, Homo sapiens
  Payload ID: 7422
  Gene Symbol: HSPA8
  Gene Name: heat shock 70kDa protein 8
  ENST ID: ENST00000524590
  CDS Start-End: 126-536
gtctgggagcgtgcagcctccacacaggcctgttgggcttgctgaggcttgggggttctgagaatctcgtcgaggcgagtgtgcggctccttctaccggcttaaagggcctcagttttcgcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaag

SEQ ID NO: 139826 - DNA, 648 bp, Homo sapiens
  Payload ID: 7422
  Gene Symbol: HSPA8
  Gene Name: heat shock 70kDa protein 8
  ENST ID: ENST00000530391
  CDS Start-End: 252-648
gggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcgggcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaag

SEQ ID NO: 139827 - DNA, 740 bp, Homo sapiens
  Payload ID: 7422
  Gene Symbol: HSPA8
  Gene Name: heat shock 70kDa protein 8
  ENST ID: ENST00000526686
  CDS Start-End: 289-740
actacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagct

SEQ ID NO: 139828 - DNA, 1048 bp, Homo sapiens
  Payload ID: 7422
  Gene Symbol: HSPA8
  Gene Name: heat shock 70kDa protein 8
  ENST ID: ENST00000525624
  CDS Start-End: 487-1048
accatttaaacctgtttattttataaacaacggggaaatgtagggcttgggctagttggggaaggactgagccaagaagccgaatctgttctagacggaggtgggaaggggcctaacggtcagggctcagagaagcggtttcgccttcttttccgcggagggatccagacacgaccgcgtcctgaggcggttctgaaaagccgggccccttaaacctctgcgtcgggggctgcctcccgacagttgccgtagggaaatgcaggtgctgggaggcctgccgagctaacccgccccaccccgcggcggcctggcggctccctccaatcccaatcctggggggccgtgagcgagcagccctagtggcaccctgaagccggaaccttcgccccagcccctcggggtcagcccttgtccaaagccacgctatgaaatacagattcgcgaaacccggggcacttagaggcccgtctggaacacgaagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaa

SEQ ID NO: 139829 - DNA, 963 bp, Homo sapiens
  Payload ID: 7422
  Gene Symbol: HSPA8
  Gene Name: heat shock 70kDa protein 8
  ENST ID: ENST00000524552
  CDS Start-End: 295-963
ctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccc

SEQ ID NO: 139830 - DNA, 579 bp, Homo sapiens
  Payload ID: 7422
  Gene Symbol: HSPA8
  Gene Name: heat shock 70kDa protein 8
  ENST ID: ENST00000527387
  CDS Start-End: 46-579
gctgcggtgagtgcgttatcgtgaggcggagcgcggtgggcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgct

SEQ ID NO: 139831 - DNA, 583 bp, Homo sapiens
  Payload ID: 7422
  Gene Symbol: HSPA8
  Gene Name: heat shock 70kDa protein 8
  ENST ID: ENST00000525463
  CDS Start-End: 79-583
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcc

SEQ ID NO: 139832 - DNA, 2306 bp, Homo sapiens
  Payload ID: 7422
  Gene Symbol: HSPA8
  Gene Name: heat shock 70kDa protein 8
  Uniprot ID: P11142
  ENST ID: ENST00000532636
  CDS Start-End: 121-2061
ggtttgcctggcgcgcggggaagtggagccagcgttttctttcacccagttccctgcttagtccagtcccaccgtggttcttcagagctgttcttggcgtgcttccagtatggggcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 139833 - DNA, 1826 bp, Homo sapiens
  Payload ID: 7422
  Gene Symbol: HSPA8
  Gene Name: heat shock 70kDa protein 8
  ENST ID: ENST00000533540
  CDS Start-End: 79-1581
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 139834 - DNA, 3321 bp, Homo sapiens
  Payload ID: 7423
  Gene Symbol: HSPA9
  Gene Name: heat shock 70kDa protein 9 (mortalin)
  Uniprot ID: P38646
  ENST ID: ENST00000297185
  CDS Start-End: 127-2166
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 139835 - DNA, 518 bp, Homo sapiens
  Payload ID: 7423
  Gene Symbol: HSPA9
  Gene Name: heat shock 70kDa protein 9 (mortalin)
  ENST ID: ENST00000505110
  CDS Start-End: 84-200
agaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccagatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtca

SEQ ID NO: 139836 - DNA, 887 bp, Homo sapiens
  Payload ID: 7423
  Gene Symbol: HSPA9
  Gene Name: heat shock 70kDa protein 9 (mortalin)
  ENST ID: ENST00000504902
  CDS Start-End: 1-301
cgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagag

SEQ ID NO: 139837 - DNA, 482 bp, Homo sapiens
  Payload ID: 7423
  Gene Symbol: HSPA9
  Gene Name: heat shock 70kDa protein 9 (mortalin)
  ENST ID: ENST00000512328
  CDS Start-End: 1-307
aacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggagga

SEQ ID NO: 139838 - DNA, 551 bp, Homo sapiens
  Payload ID: 7423
  Gene Symbol: HSPA9
  Gene Name: heat shock 70kDa protein 9 (mortalin)
  ENST ID: ENST00000507886
  CDS Start-End: 366-551
atttcaaaattaccaggtagtggtcctcatggcctgttctgtggctgaatggaaaggtttggccttgggggtgagggatgcagtctattgggaaagccactattttcagttttatttttggctcctctacagaatacagagtgtgtaaggatcccgttgatacggtgaaataaaataagaaagctctgagtcggaactccagttttcgtgcttagcaacattttctcaaaatctgtggtgatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcct

SEQ ID NO: 139839 - DNA, 663 bp, Homo sapiens
  Payload ID: 7423
  Gene Symbol: HSPA9
  Gene Name: heat shock 70kDa protein 9 (mortalin)
  ENST ID: ENST00000507115
  CDS Start-End: 86-214
ccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatacacactggttggtgactgagtcagttttttcttttttaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcag

SEQ ID NO: 139840 - DNA, 584 bp, Homo sapiens
  Payload ID: 7423
  Gene Symbol: HSPA9
  Gene Name: heat shock 70kDa protein 9 (mortalin)
  ENST ID: ENST00000504810
  CDS Start-End: 300-584
ccgcgcgccctttagggtttgaattctccagtataggtcaggcgggaaggaaggtaacgggccttccatagttagcgctgccgggtcaagattttgcccaaggttttgcctccggcttgggccctgctgagtcacacccctcgcgatctagagtgtcatttcaaaattaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagt

SEQ ID NO: 139841 - DNA, 780 bp, Homo sapiens
  Payload ID: 7423
  Gene Symbol: HSPA9
  Gene Name: heat shock 70kDa protein 9 (mortalin)
  ENST ID: ENST00000523929
  CDS Start-End: 1-491
ttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggaaatatgcaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttg

SEQ ID NO: 139842 - DNA, 8784 bp, Homo sapiens
  Payload ID: 7424
  Gene Symbol: HSBP1
  Gene Name: heat shock factor binding protein 1
  Uniprot ID: O75506
  ENST ID: ENST00000433866
  CDS Start-End: 235-465
gggaggggctatgcgaaagaaggcggggagagtggggtggggccgctccttggaacggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgctatgaagcttcctttgtgtcaaaaatctgtttggttttcagatggaaatgcagaaatcacattagagtatcaactaaaacctctggacggattaagtacaagtagcccaaggcaaagcaggagagggggtgttgggggaggttgcctgctggaaggggaagctgaggagcgggaggagggcttgccaagactggcattgcaggagacttgtctcaggtgtgttcccagaactcttgcccctggagatgctgcaggaaggaaggggttatggtcacttgggtttagacgacattctgtgaacctcatgaagaaattagcatattaaagactctgaaagtagagcagagaactcagctttaacctgctcacctgctagttttcgaggtctcgctctgttgcccaggctggagtgcagtggcacagtcatagctcacttggagcctgaagctcctgggctcaggcagtcctcctgcctcagcctcccaagtagctaatattacaggttcgtgccaccgcacctgggtcttgctgtgttgcccaggctggtctagaactcctaggctcaagcagtcctgtctcagcctcccaaagtgctgggattacaggctggagccaccatgcctgtccaagggtcttttttatactatatgaagtattccttctccagctattcttgttcgtttaccagccagtgaagattctcttgagggctgaacaatacagatgagtatgggggccctcgcaccaaggaaaacagcgttacatttaattaagtgccctgtctcaaaccccaaggccccacagcttcttcatttggcccctagttcatcctgctttcctttgagccacaggattttaaaatatttcaatcttattttcatatcaattttttctttgtttcactacaagtacagtcattgtttaaccctatcaggactaacacaatatttcacgtaactaagagttaatttgcccttgtgagtccttggaatttaagccccacacacacacacttagagcactgttgctatgggaacatagagtcctccaaacaaaagtgaactttttcaacatgctgtttgtaaatggaagccttcccaagcagacactgtgttcctcttttattttgtattttgcacattatatattttgattagattaaaatggaggaatttgcaggatgtgttgtcatatctagccctgaaagttaactggttacagttaccaaatgttcacagctagcgccattgaaagcattgactgtaaaccgctgtactgtgctaagccttttgtttgcactgtttggcttaatcctcacaacaacactgagaggttttcatttgatgagtcatatttaaagaaaaggaacccaagacggggagtcaggggcacaaggtcacagctggtaatgatgaccctggaatgtcctcacagctgcacacctgcaccgctcacaaacacagctgaccgtctcacagctgcacacctgcaccgctcacgagcacagctgaccgtctcacagctgcacacctgcactgctcacgaacacagctgatcgtctgcctcttcgtgtgagctgagctccgaatctcagctgtccaggctgtctggaaatcatcagccccactggctggatctcaaaatttactttcaaaaggctgatggagtgttttcaattaaacatgacctaaaattaagtaataaacacactggatgtgagtttttatttggaatttaaactattcagagctggtagaaaatgtgtgctcctggatcagtgccttttttctcctaaatcagttgagaacaacaacagaaacaaatgacattcctcaaacatttgcccagagcacaaccacggggaatatgaaccacaggttttcacattggttttccatgcctatacctgtcctgtctcccacaaaaattattgcttgaggcccaacccgggggataaaaagacacccccccgccactccgtgacctattagcttaccatcctattggatttcactgttttttgttttgtggtgttttttttttattgcaacgaagacttttaaatggactcatgaagaagccatcacctggaatcttaatcttgcattaattttaagtgtctgattttagctgcagccacttgagaacttttcaatgaatgaaaatgagggaggggagatgcaagtcactgcccaaaaacaaaaccagaggaattgtgattgaacattgcacttatcaaccctacaaattaatatggaaataggaaaagggtttgtttcaacaagtcaggatgacagtattttaaaaaagaaaaaaaggccagcctgggcaatatactgagactccatctctacaaaaaagtagaaaaattagcccagagtgtggtggcacacatctgtgctcccagctactcaggaggctgaggtgggaggatcatttgagcccaggaagtcgaggttgcagtgagctgtgatcggacgactccactccagccggggtgacagagcaagaccctgtctcaaaaaaaaaaaaaaagggcggatcctaacgcttggtcctcacacctgaggctctcactaagaggtggctggaagctcctcagaccgctgcctagggttcgagtgatcctgaaagctgtacaacatcagcctctgtgggatccctgagaatgatgaaatgtaatatgtggctgtctcatcaacagagcttcattttaccaaagcatatgtagacaccacatacatgaactacatacctatcgtgtagatgctgccctgcctcataagaacactcttgactgtcctgcttcacaataataatcttcgcaataatgatctaataatggtcaaattctgtgtctctaccgtagaaaacagaatttgaccatttagtcacgttggtcttgcaaaatgtccaccttccaaaagagaacagtattgcttcccaataattaagaatagtctggattcaggatccagcagcttagaagcgtttagctaccaatagcaaaaatcagcccttttaacaatggtgggatgtattatttcacatggcaagaagtcccaagggagggcagctctggggcgagtaaattctgcacctcagtaaaactaagagcaagacccggccgggcgcagtggctcatgcctgtaatcccagcactttgggaggccgaggtgggtggatcacctgaggtcaggagttctaaaccagcctggccaacatggcgaaacccccgtctctactaaaaatacaaaaattagccaggcgtggtggtgggcgcttgtaatcccagttgctcgggaggctgagggaggaggatcgcttgaactcaggaggtggaagttgcagtgagccgagatcgtgccactgcactccagcctgggtaacagagcgagactccatctcaaaaaataaaaaacaaaaaaataaataaaaaataaaaagacccaaccccagatttgttccacctgggtgcatccggtcagagaatgcctttcttcttcccttttgtctcctaagagtgaagaaaatgtttctttgaaggtgtttccaccccactcctgtgcctaaaatgatcctggcaaacaggacccgcatgataggttgagccatgtggttcttgtttttttgttgtcacaactcaggttgggggtgttactggcatcaagagtgtagaaaccagggatgctgcgtcaacaccctaccatgcacaggacaaccctcaccccaaagagtggcacagccccaagtgtcaacagtgctgaggttgaggaatcccagcttaacccattcatgagaccacctgagcctggtgtaacggttctgctgatagtttccggaccctcagaggtggagacataagagaacaataccagggttccatcagaaaggaaatcagaatggctatcgggtggacaacctacagtgtttgctacagaccttctagatgtaacttctagattataaacactggtaacactggagatggttaaatcggaattagctgactgtcaaccttggtggcacattagaatcacctggggagcagttcaaaggcccaaaactgggcagcaccacagaaccctcacatcagaatccccatgggtgggcccagacagcagtgttcatcttagactccagtgtgcagtcgaggtcgagaactgcattcaagaaggcctgtctactgcgaaccgtccgatgatgtaattcaccaagttccatgggattccgccacgcccgtgtcaacccagctgacacgtccaacttggacaatcagggctttgacccccgttacctggcattcaattcaatccatgtgtcacgcatgccccaacaatttgtgtcccaactgtttgaatcaaaggatttctgattccctgatgggtgatgactcagtaaccggattcagcttcagatctgcctgacatttttcctgcctgtcctgggccaggtatggcgctagctgctttcacctgtatcatctcattcactgctcagaggctctcgaaagctgttgacattatcaaaaagttttccagctggaattcatctccctctaatcagccttcaaaacctccatttgtaaaccattgctgtagttttattacctcttaccttggtctttacaagttgctgtcaaaacccagtaagtgtttacagaaagaaactttacatattaaatatcttaaaggtcttttatgcagaatatgcagttaattttgatgggctatggataatcatcagaagagccatttctggaaatgtaaataatatggctgtttcttttaacagtgcattctcctgaaaacataagaccatttgactgattctgctccagaatcttattgaggcaaaggactggaccgaattattcatggaacagaagcctaggactggtaagtccaggaaatgctgcaaaacaatgccctcaaaagaaatcagcctttccctttgataggtatctctcctgcaagccaggctcaggtgcgcctcaattagaacctgtgttcgctggggccataattaagaatcttaaagggaaagaatgttttgaaagccatctgtcaaaagtacgcagtcttgcttgtagaattttagaggttcatggttaccgtgggtcggcactgggtctgtgagccctcatccccagggctcggtttcctatcagaatccttgtctggaaggttgattatatcagatgcgcattttgccagcatcctcagaaggagatgcgaggaagattcttttcctgggccactctcattttctcaaacttggacaagtcttaacaataatctgtgacccaactttgtcttccccatgatgaaaaacagaccccatagaaactctctggcacaaaaactctggaatcactgaccccagacattgttccctgccatccactctgccagacatttcttggatttattcaagctgacttgtattccagaacaattgtggacaagatttgctagtaatgcttccaacaagttaccgtttagcaagttcagaacttgaagaatcccttttatcctaacgctgactaataaactggtgagaactgtttgaaatacccataagtcaatggaggtcgtaatttgcttttatgctgtattaaacaccactgagatgttaaggtctttcttgggaaccaccgtgatgttctcttctggactcttcgtaaccccttcagcagacgaccctgtatctggtcttggttctgaaaggtttgcagcggcacctaagtcactgaagttctggcagaattcattctcctgctctctactgggacttgttttccataattggtctgagaacaacagatttttttcttttttgcctcggatttcaacaaaacatacatggaaagaatattttcttccttggagacatttcccatagggcagtggttcttaaaatacgttcctgaaccggcagcatcagaatcccctgggaacgtgctggaaatgtagatccccaggccctacctagccctactgaatcagagaccctgggagggaggtccagcagcctgggttttaacacatcctccaggcgattctgagagtgagagagccagggccttcgggcatcaaccttggggcgagggtgttgggttgcccaacaccctttagtctaatggctttagggtcaaatatgtctaaaccaagaagccccatggggcactgattagcatgcaggtccccaggccccctttttgtagatcctgattcagaatatctgggacgggggctggagattcatatttttaataaattccctcatttattatttttgtgtcttatttcccatacacaaaaacactgcgtagagaaatgggagtgtgggcgatgctcccatgctgggagtctcaggcctgggctagtcctaaaataattgaaaaggaattgattcttaattacccagaacgtccacgctctaggacctagtgtgacctcttctgccttctgaaccgaggagtccacccctaagcccgaggaactgagcgtgaagagccctgacgccatgaagacttgaatcactttaaagcaatttgcttcttattaaaatgtacttcagtaaaaaatcatttcaactcttaagccacaaaaggatatccaatcatttaaagcttcctgagtgtttcggttgattaaaaagcttttaaagagcatagtaaatattttaccagaaggataagttattcagtatggagattatttattaaaaactagtaatttatt

SEQ ID NO: 139843 - DNA, 889 bp, Homo sapiens
  Payload ID: 7424
  Gene Symbol: HSBP1
  Gene Name: heat shock factor binding protein 1
  ENST ID: ENST00000567382
  CDS Start-End: 16-216
ctgggcatcggggagatggccgagactgaccccaagaccgtgcaggacctcacctcggtggtaagggacggctgtgagggccggaggccgcggccttcccgggcggcgccgggccaagccctgctggacagaggcgcgcccaccgcggccgcgcgtggcgtctgccgaggccccgtttctggaagcgtctctggccgaggctcccggccaccttgacccccggggcgctcggtgcgggccagtctccccgcgggcgcccccaagcccgaccccttccagtagccccattcatctgtcgcgaacgccctccgggtccctcccgcctacctctgacaccctccccgcccttcaactcctcacacacccccgggtgccccagcccggcagaaacaacctaaagaccctgagctttgagtcgcagcggcctccccagcccagcagtctaattggacaggttggaaaacggaagcccagagaaggaagatcttgctgaaggccgcacagctgtccagaggcagaaatggggctggaaccccgggaccagggcttgcgtcctgatcccaggaagttgtctcaggatcgatgtggaccgtgtttgtttgtttcggtttttcttaggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtg

SEQ ID NO: 139844 - DNA, 1020 bp, Homo sapiens
  Payload ID: 7424
  Gene Symbol: HSBP1
  Gene Name: heat shock factor binding protein 1
  Uniprot ID: O75506
  ENST ID: ENST00000570259
  CDS Start-End: 89-319
gagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaagtgcattctcctgaaaacataagaccatttgactgattctgctccagaatcttattgaggcaaaggactggaccgaattattcatggaacagaagcctaggactggtaagtccaggaaatgctgcaaaacaatgccctcaaaagaaatcagcctttccctttgataggtatctctcctgcaagccaggctcaggtgcgcctcaattagaacctgtgttcgctggggccataattaagaatcttaaagggaaagaatgttttgaaagccatctgtcaaaagtacgcagtcttgcttgtagaattttagaggttcatggttaccgtgggtcggcactgggtctgtgagccctcatccccagggctcggtttcctatcagaatccttgtctggaaggttgattatatcagatgcgcattttgccagcatcctcagaaggagatgcgaggaagattcttttcctgggccactctcattttctcaaacttggacaagtcttaacaataatctgtgacccaactttgtcttccccatgatgaaaaacagaccccatagaaactctctggcacaaaaactctggaatcactgaccccagacattgttccctgccatccactctgccagacatttcttggatttattcaagctgacttgtattccagaacaattgtggacaagatttgctagtaatgcttccaacaag

SEQ ID NO: 139845 - DNA, 771 bp, Homo sapiens
  Payload ID: 7425
  Gene Symbol: HSBP1L1
  Gene Name: heat shock factor binding protein 1-like 1
  Uniprot ID: C9JCN9
  ENST ID: ENST00000451882
  CDS Start-End: 176-400
aggtgcagcgcccgcctctccgctccggccccgcctccgccctggaacgcagcgcgctccgcccgaggcctcccggcggcccatacgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaatggaagaaatgggaaatcgcattgaggacttacagaagaatgtcaaggacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaagagacgcaaggggctcgcctgctctcccctccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaacttacaaatgtggaatgtaa

SEQ ID NO: 139846 - DNA, 800 bp, Homo sapiens
  Payload ID: 7425
  Gene Symbol: HSBP1L1
  Gene Name: heat shock factor binding protein 1-like 1
  ENST ID: ENST00000589516
  CDS Start-End: 107-244
ctcccggcggcccatacgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaaatatccttttctacctttaacaaatgctgtgattctttcggactggtagattatcatggagtatctttttgttgtctggtagtagtagttgcatgtgccatgggaggcggagtctctgaggacatcctggctgtgcctcggcggctctggactccagctctacgcagagcgccttaacactgtactggaagaaatgggaaatcgcattgaggacttacagaagaatgtcaaggacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaagagacgcaaggggctcgcctgctctcccctccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagta

SEQ ID NO: 139847 - DNA, 3986 bp, Homo sapiens
  Payload ID: 7426
  Gene Symbol: HSPA13
  Gene Name: heat shock protein 70kDa family, member 13
  Uniprot ID: P48723
  ENST ID: ENST00000285667
  CDS Start-End: 69-1484
gccgggaggagtgggggcggtgcctcacgtctggtacagtcatcacaagcctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatataatagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccgagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgtttttgttgtttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaattgctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtaaataaataccattttgcagtttgttttttaaa

SEQ ID NO: 139848 - DNA, 3379 bp, Homo sapiens
  Payload ID: 7427
  Gene Symbol: HSP90AA1
  Gene Name: heat shock protein 90kDa alpha (cytosolic), class A member 1
  Uniprot ID: P07900
  ENST ID: ENST00000216281
  CDS Start-End: 207-2405
gtgccgcggcaacggcgcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggcctta

SEQ ID NO: 139849 - DNA, 3510 bp, Homo sapiens
  Payload ID: 7427
  Gene Symbol: HSP90AA1
  Gene Name: heat shock protein 90kDa alpha (cytosolic), class A member 1
  Uniprot ID: P07900
  ENST ID: ENST00000334701
  CDS Start-End: 283-2847
gggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagcagggcacctgttaactggtaccaagaaaaggcccaagtgtttctctggcatctgatggtgtctggatccaccactctactctgtctctggaaacagcccttccacgtctctgcattccctgtcaccgcgtcactggccttcagacagagccaaggtgcagggcaacacctctacaaggatctgcagccatttatattgcttaggctactgatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaag

SEQ ID NO: 139850 - DNA, 581 bp, Homo sapiens
  Payload ID: 7427
  Gene Symbol: HSP90AA1
  Gene Name: heat shock protein 90kDa alpha (cytosolic), class A member 1
  ENST ID: ENST00000553585
  CDS Start-End: 60-581
agttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaa

SEQ ID NO: 139851 - DNA, 1710 bp, Homo sapiens
  Payload ID: 7427
  Gene Symbol: HSP90AA1
  Gene Name: heat shock protein 90kDa alpha (cytosolic), class A member 1
  ENST ID: ENST00000554401
  CDS Start-End: 1-157
ggttgagacgttcgcctttcaggcagaaattgcccagttgatgtcattgatcatcaatactttctactcgaacaaagagatctttctgagagagctcatttcaaattcatcagatgtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtatgtgaatacagcatttcctgatcattgatacttctaaggtgctttcaagcttagtcatacatagcccattttcgcatgttttcaacttaaaacagaaaactatgttgtgtgtggctgggcgcggtggctcacgcctgcaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgcaccactgcactccagcc

SEQ ID NO: 139852 - DNA, 584 bp, Homo sapiens
  Payload ID: 7427
  Gene Symbol: HSP90AA1
  Gene Name: heat shock protein 90kDa alpha (cytosolic), class A member 1
  ENST ID: ENST00000557234
  CDS Start-End: 62-304
gcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgca

SEQ ID NO: 139853 - DNA, 595 bp, Homo sapiens
  Payload ID: 7427
  Gene Symbol: HSP90AA1
  Gene Name: heat shock protein 90kDa alpha (cytosolic), class A member 1
  ENST ID: ENST00000558600
  CDS Start-End: 296-595
aggctcctcccccgggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagggcacctgttaactggtaccaagaaaaggcccaagtgtttctctggcatctgatggtgtctggatccaccactctactctgtctctggaaacagcccttccacgtctctgcattccctgtcaccgcgtcactggccttcagacag

SEQ ID NO: 139854 - DNA, 2582 bp, Homo sapiens
  Payload ID: 7428
  Gene Symbol: HSP90AB1
  Gene Name: heat shock protein 90kDa alpha (cytosolic), class B member 1
  Uniprot ID: P08238
  ENST ID: ENST00000353801
  CDS Start-End: 123-2297
ggcacgcagtagctctctcgagtcactccggcgcagtgttgggactgtctgggtatcggaaagcaagcctacgttgctcactattacgtataatccttttcttttcaagatttttattttagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 139855 - DNA, 2674 bp, Homo sapiens
  Payload ID: 7428
  Gene Symbol: HSP90AB1
  Gene Name: heat shock protein 90kDa alpha (cytosolic), class B member 1
  Uniprot ID: P08238
  ENST ID: ENST00000371554
  CDS Start-End: 215-2389
gtgcccggatgctggggcgagggagggtgcactgcggcgccccctcctcgcgtggtcctggccgacgcatgtccggcagtgacgagtgtcggcctggtggctacggccaccatctttcttgggtttggtcctgttctgtaattttgtgctgtgaaagggtcgtggtggagcttttggcttaagaattctttgtccggatttaattgctcctccgatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 139856 - DNA, 2572 bp, Homo sapiens
  Payload ID: 7428
  Gene Symbol: HSP90AB1
  Gene Name: heat shock protein 90kDa alpha (cytosolic), class B member 1
  Uniprot ID: P08238
  ENST ID: ENST00000371646
  CDS Start-End: 110-2284
ggcacgcagtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacagtt

SEQ ID NO: 139857 - DNA, 2644 bp, Homo sapiens
  Payload ID: 7428
  Gene Symbol: HSP90AB1
  Gene Name: heat shock protein 90kDa alpha (cytosolic), class B member 1
  Uniprot ID: P08238
  ENST ID: ENST00000620073
  CDS Start-End: 180-2354
agaggggggtcccccccgcaggtactccactctcagtctgcaaaagtgtacgcccgcagagccgccccaggtgcctgggtgttgtgtgattgacgcggggaaggaggggtcagccgatccctccccaaccctccatcccatccctgaggattgggctggtacccgcgtctctcggacagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacagttct

SEQ ID NO: 139858 - DNA, 2858 bp, Homo sapiens
  Payload ID: 7429
  Gene Symbol: HSP90B1
  Gene Name: heat shock protein 90kDa beta (Grp94), member 1
  Uniprot ID: P14625
  ENST ID: ENST00000299767
  CDS Start-End: 183-2594
gattggtgggttcatgtttcccgtcccccgcccgcgggaagtgggggtgaaaagcggcccgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaata

SEQ ID NO: 139859 - DNA, 590 bp, Homo sapiens
  Payload ID: 7429
  Gene Symbol: HSP90B1
  Gene Name: heat shock protein 90kDa beta (Grp94), member 1
  ENST ID: ENST00000540297
  CDS Start-End: 107-268
agtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagaggtccagataaagtctaacaccctgtatttaaatacccgagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacaga

SEQ ID NO: 139860 - DNA, 581 bp, Homo sapiens
  Payload ID: 7429
  Gene Symbol: HSP90B1
  Gene Name: heat shock protein 90kDa beta (Grp94), member 1
  ENST ID: ENST00000549334
  CDS Start-End: 436-581
attcattggacgttttcccttagaggccaaggccgcccaggcaaaggggcggtcccacgtgtgaggggcccgcggagccatttgattggagaaaagctgcaaaccctgaccaatcggaaggagccacgcttcgggcatcggtcaccgcacctggacagctccgattggtggacttccgccccccctcacgaatcctcattgggtgccgtgggtgcgtggtgcggcgcgattgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaac

SEQ ID NO: 139861 - DNA, 694 bp, Homo sapiens
  Payload ID: 7429
  Gene Symbol: HSP90B1
  Gene Name: heat shock protein 90kDa beta (Grp94), member 1
  ENST ID: ENST00000550595
  CDS Start-End: 1-443
gccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaagatgagctgagctggacaactaaaagcacctgtagcagttctccccaacacagcactgagcacaagtctaggcagtcatcatggtctcctctgctcgactctgcccagaccttccagttctccgaccgaaagacttgtgatccagttttgctacaaagaacaaagtggttgacaacagtgacagtaattgctggagcaaaaccaaaagacataggtaaagaacatataaatgttaataaagcacactgctttcaacacaca

SEQ ID NO: 139862 - DNA, 1338 bp, Homo sapiens
  Payload ID: 7429
  Gene Symbol: HSP90B1
  Gene Name: heat shock protein 90kDa beta (Grp94), member 1
  ENST ID: ENST00000614327
  CDS Start-End: 79-1026
gaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgt

SEQ ID NO: 139863 - DNA, 915 bp, Homo sapiens
  Payload ID: 7430
  Gene Symbol: HSPB11
  Gene Name: heat shock protein family B (small), member 11
  Uniprot ID: Q9Y547
  ENST ID: ENST00000194214
  CDS Start-End: 391-825
gggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 139864 - DNA, 765 bp, Homo sapiens
  Payload ID: 7430
  Gene Symbol: HSPB11
  Gene Name: heat shock protein family B (small), member 11
  ENST ID: ENST00000371376
  CDS Start-End: 19-243
caggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttggtaagcaaatcttacattaattttttttttttttttttggtgctccaggtaaggctaatattttagttttcattatcctttcattttttccacaggcagaaggcatatatgtaaacttttggcaaaacactagtttttctttatagcatggaatccagttttattgctggggtgaaaggatggggattatgaggtaaatgccttgagctcagttggcctctctcaaactgcaaattcgaaacccttccaaagcacataataatttccatgcaatttactatgtaaaagtctttggcaaaaggccctattaggaacataagactccagcttgctagaacactattccatgacatctttattctagattcatttgtcctggagttatttgtcaaattcttgttgaaaatctgataactctgattatttacattggatagttgagattcttctattactagtggcattttctcaggaatttagggggataatctcccttgggacatcattctaatcctatttatttaaagataaaatgtatcaga

SEQ ID NO: 139865 - DNA, 760 bp, Homo sapiens
  Payload ID: 7430
  Gene Symbol: HSPB11
  Gene Name: heat shock protein family B (small), member 11
  ENST ID: ENST00000371377
  CDS Start-End: 72-410
gcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggtaagtgaatatactttatagaattaaaaattaacctgcacaatgtatttagactttaacctatctccatagtcatagttaataaatttcctcatgatattataggtttgtacctaaatcaaccggtagagaaagttattctcaataataatataagctaaatgtacattcataaattaggttcttacctttcatagagagtgacggcaagataaaacaattcatttattttttgttttatttttctcattcatttactttgaagtatttatttggtttgctttctttcatttgattctgtaggcattttagaataggaatgaaaaaagggtcgcgatgccaaaattgaatgttaatttaagcatgaaagg

SEQ ID NO: 139866 - DNA, 894 bp, Homo sapiens
  Payload ID: 7430
  Gene Symbol: HSPB11
  Gene Name: heat shock protein family B (small), member 11
  ENST ID: ENST00000371378
  CDS Start-End: 34-678
agctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggccggagtgggatggcgctatcttggctcactgcaacctccgtctcccgggttcaagcgattctcctgcctcagcctccctaggagctgggattacaggcacctgccaccacacccagctaatttttttgcatttttagtaaagatggggttttgccatgttggccaggctggtctcgaactccagacctcaggtgatctgcccacctcagcctcccaaagtgctgggattacaggtgtgagccactgcgcccggcccggaaaagcaaattttaaatggagaagagtaggaaaggcatttcaaaagccaccttggtataccagataagagatgtgaaggtgagtagtcattcataatgatgaatttggggaaagatgaataaaaaagtctgagtagagcaaaaagtgaaactaaaactgaacattacggctagatcacaggctttcaggtattttcttgtaacactggaaccatttaaggtttttgagaaggaatgtgaattatagcaattgtgttcatgttcaataaaatgaaatgctgagc

SEQ ID NO: 139867 - DNA, 1458 bp, Homo sapiens
  Payload ID: 7431
  Gene Symbol: HSPB6
  Gene Name: heat shock protein, alpha-crystallin-related, B6
  Uniprot ID: O14558
  ENST ID: ENST00000004982
  CDS Start-End: 22-504
actgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgcc

SEQ ID NO: 139868 - DNA, 711 bp, Homo sapiens
  Payload ID: 7431
  Gene Symbol: HSPB6
  Gene Name: heat shock protein, alpha-crystallin-related, B6
  ENST ID: ENST00000587965
  CDS Start-End: 2-415
gatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggtgagccgcggcgtggggcggggctggagcgggtacgctcgccgccgggccggaggggcggggccgctcaagcctccctcccctccaggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctc

SEQ ID NO: 139869 - DNA, 1634 bp, Homo sapiens
  Payload ID: 7431
  Gene Symbol: HSPB6
  Gene Name: heat shock protein, alpha-crystallin-related, B6
  Uniprot ID: O14558
  ENST ID: ENST00000592984
  CDS Start-End: 198-680
gaccaatgaaagagaggaaacagaagtacccggagggaggtgtttcaggattggctgggacgactgcctgcccgacagggcgtgtttgattggagaacctgccgagtgtagcagtaattggcaagaccgtgcaccaatgggaaggatctgaggctgggcttgcggttaggaggggcactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgcc

SEQ ID NO: 139870 - DNA, 1922 bp, Homo sapiens
  Payload ID: 7432
  Gene Symbol: HSPB9
  Gene Name: heat shock protein, alpha-crystallin-related, B9
  Uniprot ID: Q9BQS6
  ENST ID: ENST00000565659
  CDS Start-End: 1421-1900
ctcactgcctccagcttccagacttttctgtcctgtctcttggcccctgacagccaagtgaggcctgagtgaaggccccacattgacccctcttcacttgtaatctcttttaatggagtccgggagagtcacgatggctgtcctcttggggacaaggagtcttggggagaatcgtggggtctgcctctttcacgcgcctgtctcccacttaaccccctcccccaactcccgcacaggccctgccccacgcggctccggacacggaattgcagctgcggtagagatgagatgtagcaacagttctgcagtagtgtggtggtgacttgggtgtgttctcctcctgacattcacctgcacctttttctgcgcttttcagtatgtatgtatttaatagtatcactcaacaaaaaggagtttatcaggccgggtggctggctcacgcgggaggagagcttgagccctgcaggagttcgagaccaggctgggcaacattgggagaccccccccaccaatctctacaaaaaaataaaaaataaagtttataggctgggcgaggtggctcacgcctgtaatctcagcactttgggaggccgagatgggaggatcgcttgagcccaggagttcgagattaacctgggcaacataatgataccctgtctcttaaaaaaaaaaaattatcaaataacagcaccagaggcatagctgtggttatgatggtcaccaagaaggctactgacgtggagggtgaggcggaggagggctaggtctttctctgtgcactgggagccactctcctgaagccccaactgcgtcttcatctttgtggccccagagcccagaccacagcctgcagcacaggacgccccgggaagaattaatgcagccggagagaccagtccacctcctcgtgtcgcgtgtccgcgtggggttgtgggtggtcagggagaggtagggtggatgacccaggaaggccgccctcccctggctctgtctaggaacaatccttgccccaggcctggtccttagaaggcaagacagcccccttccagctgggggatcaatctgctgttggctgcgccagggtgcggctccctcgggtctggcctggtcgtggatccagttccttcacagctgcggcctccccgggtccattaacgaaggtggggaagggcggagaaagggtcggagtctgggaggagagcagctgcgggcgcgccagggcgctgacagtctggctcttggaggtaagatgggcgtggctgatcccgaactccgcctgcgtttgcagaagcgaagggaaccgagcgagcggagctgagctcgggtaggccgcgcgaggtccctcctctccgggcgtccgtgcgcctagctctgcgctgggagcctcgcgccctttgacagcagttagttgctgactcggatgcagagagtcggtaacaccttctccaacgagagccgggtggcatcccggtgtcccagcgtgggccttgctgaacggaaccgggtggccacaatgccggtgcggctgctcagggacagtccagcggctcaggaggacaatgaccatgccagagacggtttccaaatgaagctggatgcccacggcttcgccccggaggaactggtggtgcaggtggatggccaatggctgatggtgaccggacagcagcaactggacgtcagggacccggaaagggtcagttaccgcatgtcacagaaggtgcaccggaaaatgctcccgtccaacctgagtcctaccgccatgacctgctgcctgaccccctccgggcagctgtgggtcagaggccagtgtgtggcgctggccctccctgaagcccaaacaggaccgtccccgagactcgggagcctcggctctaaggcttccaacctgacccggtaaacaaacgacgcgatgtgcagca

SEQ ID NO: 139871 - DNA, 2105 bp, Homo sapiens
  Payload ID: 7433
  Gene Symbol: HSF1
  Gene Name: heat shock transcription factor 1
  ENST ID: ENST00000400780
  CDS Start-End: 168-1655
gcgggagcgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaatttggctcgcactccacagatgtctagggtcgcccgcctcttcccctgcccctcttcctctccgcatggccaagtccagccagggaatgagctcagtgaccacttggatgctatggactccaacctggataacctgcagaccatgctgagcagccacggcttcagcgtggacaccagtgccctgctggacatccaagagctcctgtctccccaggagccccccaggcctcccgaggcagagaacagcagcccggattcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacaca

SEQ ID NO: 139872 - DNA, 2142 bp, Homo sapiens
  Payload ID: 7433
  Gene Symbol: HSF1
  Gene Name: heat shock transcription factor 1
  Uniprot ID: Q00613
  ENST ID: ENST00000528838
  CDS Start-End: 161-1750
cgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgcta

SEQ ID NO: 139873 - DNA, 561 bp, Homo sapiens
  Payload ID: 7433
  Gene Symbol: HSF1
  Gene Name: heat shock transcription factor 1
  ENST ID: ENST00000533240
  CDS Start-End: 146-561
agaatctgctgttcacatcccggctgtgacgtcgtgtccggtgaggggcagagccaccgcctgcggctgcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctggg

SEQ ID NO: 139874 - DNA, 552 bp, Homo sapiens
  Payload ID: 7433
  Gene Symbol: HSF1
  Gene Name: heat shock transcription factor 1
  ENST ID: ENST00000530661
  CDS Start-End: 1-144
atcatctccgacatcaccgagctggctcctgccagccccatggcctcccccggcgggagcatagacgagagccctcacggacgccaggggccacacggacaccgagggccggcctccctcccccccgcccacctccacccctgaaaagtgcctcagcgtagcctgcctggacaatttggctcgcactccacagatgtctagggtcgcccgcctcttcccctgcccctcttcctctccgcatggccaagtccagccagggaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccgg

SEQ ID NO: 139875 - DNA, 775 bp, Homo sapiens
  Payload ID: 7433
  Gene Symbol: HSF1
  Gene Name: heat shock transcription factor 1
  ENST ID: ENST00000528988
  CDS Start-End: 154-348
gttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgttgcctggcagcaggcttgtttacatggtccgaccctgcaagaccggacagctccggtttgcagaagtaaatcagtgattgtctggagttggagatcagaatctgctgttcacatcccggctgtgacgtcgtgtccgaccgagtcttgctctgtcacccaggttggagtgcagtggtgcgatctcggctcactgcgacctccacctcccgggttcaagcaattctgcctcagcctcccgagtagccaggactacagagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtg

SEQ ID NO: 139876 - DNA, 684 bp, Homo sapiens
  Payload ID: 7433
  Gene Symbol: HSF1
  Gene Name: heat shock transcription factor 1
  ENST ID: ENST00000534314
  CDS Start-End: 1-275
gcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcactcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccct

SEQ ID NO: 139877 - DNA, 2549 bp, Homo sapiens
  Payload ID: 7434
  Gene Symbol: HSF2
  Gene Name: heat shock transcription factor 2
  Uniprot ID: Q03933
  ENST ID: ENST00000368455
  CDS Start-End: 193-1803
cggagacttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgatcttttcactagttctgtgcagatgaatcccacagattacatcaataatacaaaatctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtactagtg

SEQ ID NO: 139878 - DNA, 2643 bp, Homo sapiens
  Payload ID: 7434
  Gene Symbol: HSF2
  Gene Name: heat shock transcription factor 2
  Uniprot ID: Q03933
  ENST ID: ENST00000452194
  CDS Start-End: 188-1744
acttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtactagtgtctgttatgtgtcttctttagaggtgacactcacatgaaacaattttttcttctcataggaagcagtagctttaaactgtctgtggttcattattctcaatatgaatcataccaagatatttgtgcctcatctcgaaaatatattgtatattg

SEQ ID NO: 139879 - DNA, 642 bp, Homo sapiens
  Payload ID: 7434
  Gene Symbol: HSF2
  Gene Name: heat shock transcription factor 2
  ENST ID: ENST00000465214
  CDS Start-End: 1-642
cacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttct

SEQ ID NO: 139880 - DNA, 1899 bp, Homo sapiens
  Payload ID: 7435
  Gene Symbol: HSF2BP
  Gene Name: heat shock transcription factor 2 binding protein
  Uniprot ID: O75031
  ENST ID: ENST00000291560
  CDS Start-End: 333-1337
ggagtgagcgcggcagtggccctggcagctggcggagcggcccagcccgtgtgcacgtggcgccggcgctgcctttcggttgccaaaattcaggctgtagacggcgagataacaagtttaaaaccccggctaagccagaagagccaaagagggacctcgccaaggccactcctcgctctctaggccgagaatactgcgcaaattctgggaggtttgggcctggcggctctccgttcccgacccccggcgtggattcgttcccgcgctttctggcgtgaggggtcagagggcgcgccgacgctcaggcgaacggagcggaggcggcagcggccatgggcgaagcgggcgccgctgaggaggcctgccggcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaaacctggaaaggaaagagcaagaattagagcagctgaaaatggattgtgagcactttaaagcccgcctggaaaccgtgcaggccgacaacataagagagaagaaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagataaagctttgaagtttttcagcatcactggtcaaacaatggagagttttgtgaagtcgttagacggtgatgtccaggagctggattcggatgaaagtcagtttgttttcgctctggctggaattgtcacgaatgttgctgctatagcatgtggtcgtgaattcttggttaattcaagccgggtgctcttggacaccatattgcagcttctgggagacttgaagccaggacagtgtaccaaactcaaagtgctaatgctgatgtccctatacaatgtaagcatcaatttgaaaggcttgaaatacatcagcgagagtccaggattcatccctttgctgtggtggcttttgagtgatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgta

SEQ ID NO: 139881 - DNA, 989 bp, Homo sapiens
  Payload ID: 7435
  Gene Symbol: HSF2BP
  Gene Name: heat shock transcription factor 2 binding protein
  ENST ID: ENST00000443485
  CDS Start-End: 310-989
ggcagctggcggagcggcccagcccgtgtgcacgtggcgccggcgctgcctttcggttgccaaaattcaggctgtagacggcgagataacaagtttaaaaccccggctaagccagaagagccaaagagggacctcgccaaggccactcctcgctctctaggccgagaatactgcgcaaattctgggaggtttgggcctggcggctctccgttcccgacccccggcgtggattcgttcccgcgctttctggcgtgaggggtcagagggcgcgccgacgctcaggcgaacggagcggaggcggcagcggccatgggcgaagcgggcgccgctgaggaggcctgccggcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaaacctggaaaggaaagagcaagaattagagcagctgaaaatggattgtgagcactttaaagcccgcctggaaaccgtgcaggccgacaacataagagagaagaaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagtaagtatggataaagctttgaagtttttcagcatcactggtcaaacaatggagagttttgtgaagtcgttagacggtgatgtccaggagctggattcggatgaaagtcagtttgttttcgctctggctggaattgtcacgaatgttgctgctatagcatgtggtcgtgaattcttggttaattcaagccgggtgctcttggacaccatattgcagcttctgggagacttgaagccagg

SEQ ID NO: 139882 - DNA, 1568 bp, Homo sapiens
  Payload ID: 7436
  Gene Symbol: HSF4
  Gene Name: heat shock transcription factor 4
  ENST ID: ENST00000434833
  CDS Start-End: 69-1016
cactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccga

SEQ ID NO: 139883 - DNA, 1539 bp, Homo sapiens
  Payload ID: 7436
  Gene Symbol: HSF4
  Gene Name: heat shock transcription factor 4
  ENST ID: ENST00000522295
  CDS Start-End: 70-654
gcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttt

SEQ ID NO: 139884 - DNA, 717 bp, Homo sapiens
  Payload ID: 7436
  Gene Symbol: HSF4
  Gene Name: heat shock transcription factor 4
  ENST ID: ENST00000520528
  CDS Start-End: 1-52
cttctcccttagacctggcccagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccact

SEQ ID NO: 139885 - DNA, 669 bp, Homo sapiens
  Payload ID: 7436
  Gene Symbol: HSF4
  Gene Name: heat shock transcription factor 4
  ENST ID: ENST00000519601
  CDS Start-End: 1-669
cacctgccctctacctggtgcccttctgcaggacccctacttcatccagtcggaagagaagatggaagccagccttccccccaaccagacccaggccctccagcatggactgagcctcctccctcaaaccttctcccttagacctggcccagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctcccc

SEQ ID NO: 139886 - DNA, 1358 bp, Homo sapiens
  Payload ID: 7436
  Gene Symbol: HSF4
  Gene Name: heat shock transcription factor 4
  ENST ID: ENST00000521624
  CDS Start-End: 23-979
agagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttt

SEQ ID NO: 139887 - DNA, 1249 bp, Homo sapiens
  Payload ID: 7436
  Gene Symbol: HSF4
  Gene Name: heat shock transcription factor 4
  ENST ID: ENST00000517685
  CDS Start-End: 1-1249
atgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccct

SEQ ID NO: 139888 - DNA, 404 bp, Homo sapiens
  Payload ID: 7436
  Gene Symbol: HSF4
  Gene Name: heat shock transcription factor 4
  ENST ID: ENST00000521916
  CDS Start-End: 1-190
gatggacttggacatggagctgtccttgatgcagcccttggttccagagcggggtgagcctgagctggcggtcaaggggttaaattctccaagcccaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttt

SEQ ID NO: 139889 - DNA, 1555 bp, Homo sapiens
  Payload ID: 7436
  Gene Symbol: HSF4
  Gene Name: heat shock transcription factor 4
  ENST ID: ENST00000521314
  CDS Start-End: 42-185
agcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaact

SEQ ID NO: 139890 - DNA, 546 bp, Homo sapiens
  Payload ID: 7436
  Gene Symbol: HSF4
  Gene Name: heat shock transcription factor 4
  ENST ID: ENST00000517750
  CDS Start-End: 1-546
ggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgacccctacttcatccagtcgcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgct

SEQ ID NO: 139891 - DNA, 556 bp, Homo sapiens
  Payload ID: 7436
  Gene Symbol: HSF4
  Gene Name: heat shock transcription factor 4
  ENST ID: ENST00000517729
  CDS Start-End: 1-556
gggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaa

SEQ ID NO: 139892 - DNA, 1839 bp, Homo sapiens
  Payload ID: 7436
  Gene Symbol: HSF4
  Gene Name: heat shock transcription factor 4
  ENST ID: ENST00000523562
  CDS Start-End: 23-970
agagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccaggtaatggttgtgatgactcctacctgggaggacgccgtgattgggctgagctaccttgattgagtgagggggcaatctgcaatttgcagggaaatcctgagttcaggctgcactgcagagcgttccttgagccacccatgccctcaccattgggcgagagtggggaggttaagaatggatgttttatcctaactgagcagaaggcaggcgggcagggctctccttccctgaagaaaggagggggaacatttcccctggtgagcgcagtcccacttctcctagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttc

SEQ ID NO: 139893 - DNA, 637 bp, Homo sapiens
  Payload ID: 7436
  Gene Symbol: HSF4
  Gene Name: heat shock transcription factor 4
  ENST ID: ENST00000519224
  CDS Start-End: 1-233
ggcgcaaggtgcccgcgctgcgcggcgacgacggccgctggcgcccggaggacctgggtcgactactgggcgaggcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggaagagaagatggaagccagccttccccccaaccagacccaggccctccagcatggactgagcctcctccctcaaaccttctcccttagacctggcccagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctga

SEQ ID NO: 139894 - DNA, 565 bp, Homo sapiens
  Payload ID: 7436
  Gene Symbol: HSF4
  Gene Name: heat shock transcription factor 4
  ENST ID: ENST00000520304
  CDS Start-End: 1-425
ctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttt

SEQ ID NO: 139895 - DNA, 1515 bp, Homo sapiens
  Payload ID: 7436
  Gene Symbol: HSF4
  Gene Name: heat shock transcription factor 4
  Uniprot ID: Q9ULV5
  ENST ID: ENST00000521374
  CDS Start-End: 1-1479
atgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccg

SEQ ID NO: 139896 - DNA, 1549 bp, Homo sapiens
  Payload ID: 7436
  Gene Symbol: HSF4
  Gene Name: heat shock transcription factor 4
  Uniprot ID: Q9ULV5
  ENST ID: ENST00000584272
  CDS Start-End: 1-1389
atgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgccttctacttacagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttc

SEQ ID NO: 139897 - DNA, 4094 bp, Homo sapiens
  Payload ID: 7437
  Gene Symbol: HSF5
  Gene Name: heat shock transcription factor family member 5
  Uniprot ID: Q4G112
  ENST ID: ENST00000323777
  CDS Start-End: 111-1901
ggcggatgggcgccggcaggagcgggcagggcgaggcgaaggccggggagggatcgagaacggtgtgggagagctaggctcggggggcgaggccccggcccggcggggcgatggaggcgctgctctccacccccatcaaccccaacaacttccccgccaagctgtggcgcctggtgaacagcccgcgctaccgctccatccgctgggacggccgcggcgaggggctgcttatcgatcagccgctcttcgaggccgagctgctcagcccgcccgggccggggggcggtggcgggactgcgggggccggggccgagcccgagctcttcaaaaccaccagcttcaccagcttcatccgccagctcaacctctacggcttccgcaaggtggtgctgggcgggccggggggcggcaaaccggcaggcaatgggccgctccatcacttccacaacccgcacttccgccgcgaccagccacagctgctcgtgcacctcaagcgcctcaccagcgccaacaaggccaagctggcggccggcctggaggtgccctgccgcccgcccaaccgcttccagcggctgctcatcacctcggcctccgccgccaccgcgccactgcagcaccagcagccgccgccgcccgcggggccccggcccgagccgcacggaccagtggctgtaggacaatttcaccggtcatttcgtcgagatagtttgtctccttactcctgtgtatcaactccatcccacgaccacagtacttaccctctgaaaggtttagatcggaccccagttcctcatagaatatggcagaactcccttggaatgcatcctggacaagtggagacatctcccacattttcagataaaggggttccgtttcctgtactccagaggtttccaactgaggttacctatacactgcagcccagcaccacatctgtacatgttcaacaaggtcctcaaacaatggtcagctcctcccaaaaatacagtaactacacaccctcagcacagtactcgcaagcctactatccaacagctgtgctacagtgctgttctcctacccacatggatgctctaagtagttgtgtcactcccactgcctcttcctatgcacactgcaactacttccagaatccttcaatgcagtcctcctatccagttgaatttttgccttccaattggccctgcagtactactgatgaaaatacaaagacagaagtaaacctagaggctgtctttcagatagttgatgagttgcattcctcccctaaattggagatggtaaaggtggagcctgttgagaatcagtgcccaacatctccgtcttacagaggccaacacattttagctaattctaacaacagcaatccatgttctgcaagtcaggctagccagctggagccacttactcctgtaggctcagatattatgtcttttgtggttggaacagaacaagcagttgcctgctctctaccacagtcacctgagtacatctataccatccacacagctcagcctgttgaaaatagcacaatacaggaatctgcagccatccagcaagctcatgtcaaactgaaggagcacctaaatcataatccatctccatcttcagtagtatttgtgcaggaagggccaccattcagcacacaccaggtggatgccaacataaaatgccagaccagttcacgtgagaatatcttgccgtcagaacagatgggattcctcatttcagaaatggggcctgctagcaagcctagtgaagacacaggtttagccactccagccagatacagagagcacagaagcaactcacaacaaggaaagtcccctgatcttcatctgctggtggacgtggcctgcaagcaggagcgctttccaaaggaggaagaattaaaagagtgaggaatggatgacaaatgtgacattgtgcactagctgtagctggaggcagactagccttgcacatgacaaactgttgggattttttcagttctgttaaggaaaaaaaagtattttttgtttcgttaattgagaattttgttaattgagaattgggaatttgtatgtactacagtggttcagttcagattatctgccttgacaaactactgaacatctagcagccacgttttttggctgcccagatcccttttaaatgaaaagttctgaccttctgttatagtcaaggagcatctaaaaactgctccatctatggtactaagaataatctgtgtgtgtgctgatttgttgtcttgccactcaaactgtagtcagcacaactttagtggggaattcagtctctctgattcaagtcacagtgtgatccttttagaggagattgtgtgagaaacaaaggcatgtgaggtcaccagcatcacaggtctaaatgcatcaggaattccagggaagaaactctggagaagagctaattttctaagtgattaaccaggaaattctcttacttcctaacccagcattctgttttaagagcaaggcatccggacttggaccatctatcacacttaacagcccctgattcttttatattaatggaagcattcttctattttcatatctttctttaattttaatgatacattatcataaatggtaaaaagattttattaatatatcacttatttaaatgtctttaaagaaagtatttaacttgtttaatataattgtatttataaatgctgatagatttaaaggttttaaagttttatatttttattattgcaggatagaaggataaaggatgcatgtgtagtatttttattttgaaaggaaaatgtacaatgtgtgaacaaaaacattaagagatttaatatactattttcttattttagatttttacattcaataagtataaattctcatctatataaggtattgtgtgcaaatttgggaaaaaactgattagcagccatttagtagaagctatgcctctgatttttaaagaatggtttcaatctggtttaagcttctgagagaattttggataatgggatagatggtaacatttttttcttatccctgttacaggattctagatttgtgcagtaggattgtgggactgtgttttaggagagaaggatgtcttggatgtccagtttctgtggttaatcccttacttgcttatccagtgacagcaagaaactttctgatttaaagtctttcaattgaccaaaactttcttattggattctgtttcagttctcctattaagcactgcagaaacgaaaggaaagcctaggaatatgaaactaattaaaaaggcacttggtgatatgacatagtactatgctagccgttgtggatgtaacagttcatttcttatactgcattgtgccttcccaatgatgtcaaaccctagaaatattacagagatctacttttctggaaaagggtgagctctgtattgatctgcagtgactctgtttagatattaaagtaggttctgaaaagcgacctgtgtggtccctctgattagactagttaatgtctatgtgatgggcatttatttatctttattagcaaggtttaaaagagcaaattatcaagacacctatatcttttggccagactatataatattttgtcagagtatgtgaagaggagacccaatttccaaatgaaggaactttgctttttctctgtcatgttgaagagctaatatactgtgtagattttcccctaaatatggctttcttagctttatagatgttgagataatatcttttgaggaacacatgtcaagcaggaaccttggcatagatttggtttcagttgttttaaggcttaattaatgaaatgccttaatcagctttccaaacatttttatatatgaatacagcagaccaaggagctggatctcctgctatccttacacgccttgtatctatcaactaaagctgtcattaatgacttgggcaaaatggcaagaggtataataaagtcttcctgtgaattagccagtagggtctgacacaactagtcaactaacaaggttcctgactagtacctcagtatttcagcaccttaagcactgataaatttcaatcagtcaacaataaagtgagtgttccaactaga

SEQ ID NO: 139898 - DNA, 3079 bp, Homo sapiens
  Payload ID: 7437
  Gene Symbol: HSF5
  Gene Name: heat shock transcription factor family member 5
  Uniprot ID: Q4G112
  ENST ID: ENST00000617946
  CDS Start-End: 67-1494
ggggagggatcgagaacggtgtgggagagctaggctcggggggcgaggccccggcccggcggggcgatggaggcgctgctctccacccccatcaaccccaacaacttccccgccaagctgtggcgcctggtgaacagcccgcgctaccgctccatccgctgggacggccgcggcgaggggctgcttatcgatcagccgctcttcgaggccgagctgctcagcccgcccgcggggccccggcccgagccgcacggaccagtggctgtaggacaatttcaccggtcatttcgtcgagatagtttgtctccttactcctgtgtatcaactccatcccacgaccacagtacttaccctctgaaaggtttagatcggaccccagttcctcatagaatatggcagaactcccttggaatgcatcctggacaagtggagacatctcccacattttcagataaaggggttccgtttcctgtactccagaggtttccaactgaggttacctatacactgcagcccagcaccacatctgtacatgttcaacaaggtcctcaaacaatggtcagctcctcccaaaaatacagtaactacacaccctcagcacagtactcgcaagcctactatccaacagctgtgctacagtgctgttctcctacccacatggatgctctaagtagttgtgtcactcccactgcctcttcctatgcacactgcaactacttccagaatccttcaatgcagtcctcctatccagttgaatttttgccttccaattggccctgcagtactactgatgaaaatacaaagacagaagtaaacctagaggctgtctttcagatagttgatgagttgcattcctcccctaaattggagatggtaaaggtggagcctgttgagaatcagtgcccaacatctccgtcttacagaggccaacacattttagctaattctaacaacagcaatccatgttctgcaagtcaggctagccagctggagccacttactcctgtaggctcagatattatgtcttttgtggttggaacagaacaagcagttgcctgctctctaccacagtcacctgagtacatctataccatccacacagctcagcctgttgaaaatagcacaatacaggaatctgcagccatccagcaagctcatgtcaaactgaaggagcacctaaatcataatccatctccatcttcagtagtatttgtgcaggaagggccaccattcagcacacaccaggtggatgccaacataaaatgccagaccagttcacgtgagaatatcttgccgtcagaacagatgggattcctcatttcagaaatggggcctgctagcaagcctagtgaagacacaggtttagccactccagccagatacagagagcacagaagcaactcacaacaaggaaagtcccctgatcttcatctgctggtggacgtggcctgcaagcaggagcgctttccaaaggaggaagaattaaaagagtgaggaatggatgacaaatgtgacattgtgcactagctgtagctggaggcagactagccttgcacatgacaaactgttgggattttttcagttctgttaaggaaaaaaaagtattttttgtttcgttaattgagaattttgttaattgagaattgggaatttgtatgtactacagtggttcagttcagattatctgccttgacaaactactgaacatctagcagccacgttttttggctgcccagatcccttttaaatgaaaagttctgaccttctgttatagtcaaggagcatctaaaaactgctccatctatggtactaagaataatctgtgtgtgtgctgatttgttgtcttgccactcaaactgtagtcagcacaactttagtggggaattcagtctctctgattcaagtcacagtgtgatccttttagaggagattgtgtgagaaacaaaggcatgtgaggtcaccagcatcacaggtctaaatgcatcaggaattccagggaagaaactctggagaagagctaattttctaagtgattaaccaggaaattctcttacttcctaacccagcattctgttttaagagcaaggcatccggacttggaccatctatcacacttaacagcccctgattcttttatattaatggaagcattcttctattttcatatctttctttaattttaatgatacattatcataaatggtaaaaagattttattaatatatcacttatttaaatgtctttaaagaaagtatttaacttgtttaatataattgtatttataaatgctgatagatttaaaggttttaaagttttatatttttattattgcaggatagaaggataaaggatgcatgtgtagtatttttattttgaaaggaaaatgtacaatgtgtgaacaaaaacattaagagatttaatatactattttcttattttagatttttacattcaataagtataaattctcatctatataaggtattgtgtgcaaatttgggaaaaaactgattagcagccatttagtagaagctatgcctctgatttttaaagaatggtttcaatctggtttaagcttctgagagaattttggataatgggatagatggtaacatttttttcttatccctgttacaggattctagatttgtgcagtaggattgtgggactgtgttttaggagagaaggatgtcttggatgtccagtttctgtggttaatcccttacttgcttatccagtgacagcaagaaactttctgatttaaagtctttcaattgaccaaaactttcttattggattctgtttcagttctcctattaagcactgcagaaacgaaaggaaagcctaggaatatgaaactaattaaaaaggcacttggtgatatgacatagtactatgctagccgttgtggatgtaacagttcatttcttatactgcattgtgccttcccaatgatgtcaaaccctagaaatattacagagatctacttttctggaaaagggtgagctctgtattgatctgcagtgactctgtttagatattaaagtaggttctgaaaagcgacctgtgtggtccctct

SEQ ID NO: 139899 - DNA, 1963 bp, Homo sapiens
  Payload ID: 7438
  Gene Symbol: HSFX1
  Gene Name: heat shock transcription factor family, X-linked 1
  Uniprot ID: Q9UBD0
  ENST ID: ENST00000370416
  CDS Start-End: 615-1886
ctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaa

SEQ ID NO: 139900 - DNA, 1365 bp, Homo sapiens
  Payload ID: 7439
  Gene Symbol: HSFX2
  Gene Name: heat shock transcription factor family, X-linked 2
  Uniprot ID: Q9UBD0
  ENST ID: ENST00000598963
  CDS Start-End: 17-1288
ctagcaagtttgccagatggaggacaagcgatcattgagtatggctcgctgtgaagaaagaaattcgaggggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaa

SEQ ID NO: 139901 - DNA, 1444 bp, Homo sapiens
  Payload ID: 7440
  Gene Symbol: HSFY1
  Gene Name: heat shock transcription factor, Y-linked 1
  Uniprot ID: Q96LI6
  ENST ID: ENST00000307393
  CDS Start-End: 118-1323
aaccattgtgatggtctagataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttcaagcgtggctatccccaacttttagtaagagtgaagagaagaattggtgttaaaaatgcttcacctatatctactttattcaacgaagatttcaacaagaagcattttagagcaggggctaacatggagaatcataattctgccttagctgctgaagctagtgaagaaagtttattttcagcctctaaaaatttaaatatgcctctaacaagggaatcttctgtcagacagataattgcaaattcatctgtccccattagaagtggtttccctcctccttcaccttcaacctcagttggaccatcagaacaaattgcaacagatcaacatgctattttaaatcagttgaccactattcatatgcactctcatagtacctacatgcaagcaaggggccacattgtgaattttattacaaccacaacttctcaataccacatcatatctcccttacaaaatggttattttgggctgacagtggaaccatctgctgttcccacacgatatcctctggtatcagtcaatgaggctccatatcgtaacatgctaccagcaggcaacccgtggttgcaaatgcctacgatcgctgatagatcagctgcccctcattccaggctagctcttcaaccatcaccactggacaaatatcaccctaattacaactgatctgccattaaaagaggaccagattatgaatgacaacagagactaacatttacattgacaaaaaaccctaaaaatttctgcaattatcttattgaacaataaaattgcatgtttacttcta

SEQ ID NO: 139902 - DNA, 1038 bp, Homo sapiens
  Payload ID: 7440
  Gene Symbol: HSFY1
  Gene Name: heat shock transcription factor, Y-linked 1
  Uniprot ID: Q96LI6
  ENST ID: ENST00000309834
  CDS Start-End: 98-709
taagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagatacgcttcaccaaaatgaaactttccagatcttcaacttatgaaaacaggtatttatgttgcaacttacatttaaaagatgagtcgaattactcataatccttagaagttagcttgtccgcatctgaaaattcacttttaccttgaagttcaatctgtctctgggaaagactagattggaagaataaaattcaagaatgtgatgttttagtaatggaaaagccaagagcgtcaggtggcaaaagtccttctgttactcaagaaaatgctctgaaaaattccttttctcttttttttttgtaaagattaactccacctcaccaccacaatgaggtatttttctcagcaattgacacctgtttactcagttactccctgtaactatgttatgctgtgaagtaggcaatacagttgttaaagaagaataa

SEQ ID NO: 139903 - DNA, 1476 bp, Homo sapiens
  Payload ID: 7440
  Gene Symbol: HSFY1
  Gene Name: heat shock transcription factor, Y-linked 1
  Uniprot ID: Q96LI6
  ENST ID: ENST00000338876
  CDS Start-End: 98-742
taagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagcttcatgtctttgtgtttcaccacagtctatttggagcaacattcggagaacatcactttcagccatgccctttaccatctggtaacaaggctcccatttctacttggagtggagattcctggttgctgtgatgaaatgggatacactggggatccagctgcacaacttttcggaagcagcattcactgtggatttggaacatcacggacgttcttcatcttgagtcatcacttgagtaataaagtagatggagaagatgtactttctccctcacataaatgcaattaatatccgtgcgtgatatatataaagcaaacataagactgaaggatggagcaagaagataaactgattgaagcatgtctatagggagccttcctgaaccacctttcttgagctctgattatgtggcagaaagggaagatttttgaaatttgatacgcttcaccaaaatgaaactttccagatcttcaacttatgaaaacaggtatttatgttgcaacttacatttaaaagatgagtcgaattactcataatccttagaagttagcttgtccgcatctgaaaattcacttttaccttgaagttcaatctgtctctgggaaagactagattggaagaataaaattcaagaatgtgatgttttagtaatggaaaagccaagagcgtcaggtggcaaaagtccttctgttactcaagaaaatgctctgaaaaattccttttctcttttttttttgtaaagattaactccacctcaccaccacaatgaggtatttttctcagcaattgacacctgtttactcagttactccctgtaactatgttatgctgtgaagtaggcaatacagttgttaaagaagaataa

SEQ ID NO: 139904 - DNA, 1374 bp, Homo sapiens
  Payload ID: 7440
  Gene Symbol: HSFY1
  Gene Name: heat shock transcription factor, Y-linked 1
  Uniprot ID: Q96LI6
  ENST ID: ENST00000382856
  CDS Start-End: 69-713
agcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagcttcatgtctttgtgtttcaccacagtctatttggagcaacattcggagaacatcactttcagccatgccctttaccatctggtaacaaggctcccatttctacttggagtggagattcctggttgctgtgatgaaatgggatacactggggatccagctgcacaacttttcggaagcagcattcactgtggatttggtatattatgcagcttttggtgtcacaggctaaggtctgacaagattcaccatgcagttttctgggatagcagaaaatgaacatggatttggacagccagattcctcaggatggaaacctagtggtgccatctaaccatatacgtatatttccaagttgtgcataagtagaaaaagtttagaatccatcatctaaaaagggaatcctgatttcctttcctggcagaccatgacagaaagacaaaggtcatttcacctatatccacatgctattaactttttagttctcaaactgggttttcagaaggtagtgtgatagacatggttaaatggttaacaggaagaatgtttaaaaaaaaaattccggctggggtggtggctcaggcctgtaatcacagcattttgggaggccaagctgagtcaggagaatcgcttgaacccaggaggcggaggttgcagtaagctgagatcctgcttttgcgctccagcctgggtgacagagtaagacttcatcttaaagaaatccacaacaataaaaaggctaatgccagacacaataaaaaatgaaaagaataacttgggtgaacagcaaggcaa

SEQ ID NO: 139905 - DNA, 1444 bp, Homo sapiens; identical to SEQ ID NO: 139901
  Payload ID: 7441
  Gene Symbol: HSFY2
  Gene Name: heat shock transcription factor, Y-linked 2
  Uniprot ID: Q96LI6
  ENST ID: ENST00000304790
  CDS Start-End: 118-1323

SEQ ID NO: 139906 - DNA, 1038 bp, Homo sapiens; identical to SEQ ID NO: 139902
  Payload ID: 7441
  Gene Symbol: HSFY2
  Gene Name: heat shock transcription factor, Y-linked 2
  Uniprot ID: Q96LI6
  ENST ID: ENST00000344884
  CDS Start-End: 98-709

SEQ ID NO: 139907 - DNA, 1390 bp, Homo sapiens
  Payload ID: 7441
  Gene Symbol: HSFY2
  Gene Name: heat shock transcription factor, Y-linked 2
  Uniprot ID: Q96LI6
  ENST ID: ENST00000382852
  CDS Start-End: 69-713
agcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagcttcatgtctttgtgtttcaccacagtctatttggagcaacattcggagaacatcactttcagccatgccctttaccatctggtaacaaggctcccatttctacttggagtggagattcctggttgctgtgatgaaatgggatacactggggatccagctgcacaacttttcggaagcagcattcactgtggatttggtatattatgcagcttttggtgtcacaggctaaggtctgacaagattcaccatgcagttttctgggatagcagaaaatgaacatggatttggacagccagattcctcaggatggaaacctagtggtgccatctaaccatatacgtatatttccaagttgtgcataagtagaaaaagtttagaatccatcatctaaaaagggaatcctgatttcctttcctggcagaccatgacagaaagacaaaggtcatttcacctatatccacatgctattaactttttagttctcaaactgggttttcagaaggtagtgtgatagacatggttaaatggttaacaggaagaatgtttaaaaaaaaaattccggctggggtggtggctcaggcctgtaatcacagcattttgggaggccaagctgagtcaggagaatcgcttgaacccaggaggcggaggttgcagtaagctgagatcctgcttttgcgctccagcctgggtgacagagtaagacttcatcttaaagaaatccacaacaataaaaaggctaatgccagacacaataaaaaatgaaaagaataacttgggtgaacagcaaggcaagaaagaaaaaaggaaa

SEQ ID NO: 139908 - DNA, 1057 bp, Homo sapiens
  Payload ID: 7442
  Gene Symbol: HRSP12
  Gene Name: heat-responsive protein 12
  Uniprot ID: P52758
  ENST ID: ENST00000254878
  CDS Start-End: 146-559
agttcccagaatgccgcacgagcccgcccccagcgggagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttcc

SEQ ID NO: 139909 - DNA, 848 bp, Homo sapiens
  Payload ID: 7442
  Gene Symbol: HRSP12
  Gene Name: heat-responsive protein 12
  ENST ID: ENST00000520507
  CDS Start-End: 1-445
gggaaggcttagccatgtcgtccttgatcagaagggtgatcagcaccgcgaaagccccaggggccattggaccctacagctttctgtttattgcagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaa

SEQ ID NO: 139910 - DNA, 884 bp, Homo sapiens
  Payload ID: 7442
  Gene Symbol: HRSP12
  Gene Name: heat-responsive protein 12
  ENST ID: ENST00000522791
  CDS Start-End: 64-192
agccagcagggctggtgctggggcttcttctcctgaaggggctgcaagagggaaggcttagccatgtcgtccttgatcagaagggtgatcagcaccgcgaaagccccaggggccattggaccctacaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaac

SEQ ID NO: 139911 - DNA, 761 bp, Homo sapiens
  Payload ID: 7442
  Gene Symbol: HRSP12
  Gene Name: heat-responsive protein 12
  ENST ID: ENST00000521560
  CDS Start-End: 1-383
agtccagtaagaagccagcagggctggtgctggggcttcttctcctgaaggggctgcaagagggaaggcttagccatgtcgtccttgatcagaagggtgatcagcaccgcgaaagccccaggggccattggaccctacaggctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatg

SEQ ID NO: 139912 - DNA, 15337 bp, Homo sapiens
  Payload ID: 7443
  Gene Symbol: HERC2
  Gene Name: HECT and RLD domain containing E3 ubiquitin protein ligase 2
  Uniprot ID: O95714
  ENST ID: ENST00000261609
  CDS Start-End: 110-14614
gcgccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggcctgcgggcaaaggtgtggaggggctcgccagagtgggatcccgagcggcgctgtcttttgcctttgccttcctgcgcagggcctggcgatcaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacgggggatgttcacggaacgccagccaccaaagggccaggaagcatccccctgcaggaccagcacttggccctggccatcctgctggagctggctgtgcagagaggcacgctgagccaaatgttgtctgccatcctgttgttgcttcagctgtgggacagcggggcacaggagactgacaatgagcgttccgcccagggcaccagcgccccacttttgcccttgctgcaaaggttccagagcatcatttgcaggaaggatgcaccccactccgagggcgacatgcaccttttgtctggccctctgagccccaatgagagtttcctgaggtacctcacccttccacaagacaacgagcttgccattgatctgcgacaaacggcggttgttgtcatggcccatttagaccgtctggctacgccctgtatgcctccgctgtgtagctctccgacatctcataagggatcattgcaagaggtcataggttgggggttaataggatggaaatactatgccaatgtgattggtccaatccagtgcgaaggcctggccaacctgggagtcacacagattgcctgtgcagagaagcgtttcctgattctgtcacgcaatggccgcgtgtacacacaggcctataatagtgacacgctggccccacagctggtccaaggccttgcctccagaaacattgtaaaaattgctgcccattctgatggtcaccactacctagccttggctgctactggagaggtgtactcctggggctgtggggacggcggacggctgggccatggggacactgtgcctttggaggagcctaaggtgatctccgccttctctggaaagcaggccgggaagcacgtggtgcacatcgcttgcgggagcacttacagtgcggccatcactgccgagggggagctgtacacctggggccgcgggaactacggccggctgggccatggctccagtgaggacgaggccattccgatgctggtagccgggcttaaaggactgaaggtcatcgatgtggcgtgtgggagtggggatgctcaaaccctggctgtcactgagaacgggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctggatctcctgcttcggcaggtgagtgaggggatggatggttccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggatattgaagccaaaaaagaagcacagaaggaaaaagaaattgatgaacaggaagcgaatgcctcaacatttcatagaagcaggactccactggataaagaccttattaatacggggatctgtgagtcttctggcaaacagtgtttgcctctggttcagctcatacaacagcttcttagaaacattgcttctcagactgtagccagattgaaagatgttgcccgtcggatttcatcatgtctggactttgagcaacacagtcgtgaaagatctgcttcattggatttgttactgcgttttcaacgtttgcttattagtaaactttatccaggagaaagtattggtcagacctcagatatttctagtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtgttctccttccagaactagtagtttctatagtgcttctgctcagtaaaaatgctggtctcatgcaagaggctggagctgtacctctgctgggtggcctgttggaacatctggatcggttcaaccatctggcaccaggaaaggaacgggatgatcatgaagagttagcctggcctggcataatggagtcattttttacaggtcagaactgtagaaataatgaggaagtgacacttatacgcaaagctgatttggagaaccataataaagatggaggcttctggactgtgattgacgggaaggtgtatgatataaaggacttccagacacagtcgttaacaggaaatagtattcttgctcagtttgcaggggaagacccagtggtagctttggaagctgctttgcagtttgaagacacccgggaatccatgcacgcgttttgtgttggccagtatttggagcctgaccaagaaatcgtcaccataccagatctggggagtctctcttcacctctgatagacacagagaggaatctgggcctgcttctcggattacacgcttcgtatttggcaatgagcacaccgctgtctcctgtcgagattgaatgtgccaaatggcttcagtcatccatcttctctggaggcctgcagaccagccagatccactacagctacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgttgttatgttgcctcttaaaacatgaagatttaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccgttggaggaggatagctcaaaagataattcgagaacgaaggaaaaagagagttcctaagaagccagaatctacggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaaaatgagaaagtgcctactaaaacagttggagagagcagaggttcgcctggaagggatagatacaattttaaaactggcgagcaagaatttcttacttccatctgtgcagtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccaaatttaaagagcttggtatccagccggttcccctgcaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactgcacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagaccctttaggtgcttcctatttaggcgtgccttcagatgctgattcttctgctgccagtaataaaataagtggtgcaagtaattctaagccaaatcgcccttctcttgccaagattctcttgtcattggatggaaatctggccaaacagcaggccttatcacatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactggtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcgctcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgattttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccccctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaa

SEQ ID NO: 139913 - DNA, 3121 bp, Homo sapiens
  Payload ID: 7443
  Gene Symbol: HERC2
  Gene Name: HECT and RLD domain containing E3 ubiquitin protein ligase 2
  ENST ID: ENST00000564734
  CDS Start-End: 107-349
ccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagtagagacagggtttcaccgtgttagccaggatggtctcgagctcctgacctcgtgatccgcccgcctcagcctcccaaagtgctgggattataggcgtgagccaccgtgcctgatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggcctgcgggcaaaggtgtggaggggctcgccagagtgggatcccgagcggcgctgtcttttgcctttgccttcctgcgcagggcctggcgatcaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacgggggatgttcacggaacgccagccaccaaagggccaggaagcatccccctgcaggaccagcacttggccctggccatcctgctggagctggctgtgcagagaggcacgctgagccaaatgttgtctgccatcctgttgttgcttcagctgtgggacagcggggcacaggagactgacaatgagcgttccgcccagggcaccagcgccccacttttgcccttgctgcaaaggttccagagcatcatttgcaggaaggatgcaccccactccgagggcgacatgcaccttttgtctggccctctgagccccaatgagagtttcctgaggtacctcacccttccacaagacaacgagcttgccattgatctgcgacaaacggcggttgttgtcatggcccatttagaccgtctggctacgccctgtatgcctccgctgtgtagctctccgacatctcataagggatcattgcaagaggtcataggttgggggttaataggatggaaatactatgccaatgtgattggtccaatccagtgcgaaggcctggccaacctgggagtcacacagattgcctgtgcagagaagcgtttcctgattctgtcacgcaatggccgcgtgtacacacaggcctataatagtgacacgctggccccacagctggtccaaggccttgcctccagaaacattgtaaaaattgctgcccattctgatggtcaccactacctagccttggctgctactggagaggtgtactcctggggctgtggggacggcggacggctgggccatggggacactgtgcctttggaggagcctaaggtgatctccgccttctctggaaagcaggccgggaagcacgtggtgcacatcgcttgcgggagcacttacagtgcggccatcactgccgagggggagctgtacacctggggccgcgggaactacggccggctgggccatggctccagtgaggacgaggccattccgatgctggtagccgggcttaaaggactgaaggtcatcgatgtggcgtgtgggagtggggatgctcaaaccctggctgtcactgagaacgggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctggatctcctgcttcggcaggtgagtgaggggatggatggttccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggatattgaagccaaaaaagaagcacagaagg

SEQ ID NO: 139914 - DNA, 598 bp, Homo sapiens
  Payload ID: 7443
  Gene Symbol: HERC2
  Gene Name: HECT and RLD domain containing E3 ubiquitin protein ligase 2
  ENST ID: ENST00000569772
  CDS Start-End: 1-598
aagagaccctttaggtgcttcctatttaggcgtgccttcagatgctgattcttctgctgccagtaataaaataagtggtgcaagtaattctaagccaaatcgcccttctcttgccaagattctcttgtcattggatggaaatctggccaaacagcaggccttatcacatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagaggtggcagatatgctgttggagctctgtgtcaccgagttggaggatgtggccacagactcgcagagcggccgc

SEQ ID NO: 139915 - DNA, 181 bp, Homo sapiens
  Payload ID: 7443
  Gene Symbol: HERC2
  Gene Name: HECT and RLD domain containing E3 ubiquitin protein ligase 2
  ENST ID: ENST00000612410
  CDS Start-End: 110-181
gcgccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacag

SEQ ID NO: 139916 - DNA, 2112 bp, Homo sapiens
  Payload ID: 7443
  Gene Symbol: HERC2
  Gene Name: HECT and RLD domain containing E3 ubiquitin protein ligase 2
  ENST ID: ENST00000620983
  CDS Start-End: 59-1630
cttatttcatgaggtcgtggcaagatggtgaagtagcagcagtgcttagggtgtgaggatggtccgtgccagggtggtgctgccgggccgcagctgtggacgtggtggtggtgtgtgtcgtgttggaaggtgtgtttgttcagacacactagtcctgggggctgctgggcacatcactggcgacatgcccaatggggtgaggcagcggtctcgggtgtccacagtcgagcgccccagatggcagggtctgcctggcgtccacacaagcaggtgtgtgaccagggaggggcccatgcacggtgcctcctcctcgtgcattcgccagtgccgcatatccccgactgtgtgcttcctgctgcggcagcggcctcacgcttgcttgcttcctcctctccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatg

SEQ ID NO: 139917 - DNA, 6969 bp, Homo sapiens
  Payload ID: 7443
  Gene Symbol: HERC2
  Gene Name: HECT and RLD domain containing E3 ubiquitin protein ligase 2
  ENST ID: ENST00000632916
  CDS Start-End: 1-6245
gtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactgcacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagaccctttaggtgcttcctatttaggcgtgccttcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactggtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaa

SEQ ID NO: 139918 - DNA, 2977 bp, Homo sapiens
  Payload ID: 7443
  Gene Symbol: HERC2
  Gene Name: HECT and RLD domain containing E3 ubiquitin protein ligase 2
  ENST ID: ENST00000633685
  CDS Start-End: 101-2977
gagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggcctgcgggcaaaggtgtggaggggctcgccagagtgggatcccgagcggcgctgtcttttgcctttgccttcctgcgcagggcctggcgatcaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacgggggatgttcacggaacgccagccaccaaagggccaggaagcatccccctgcaggaccagcacttggccctggccatcctgctggagctggctgtgcagagaggcacgctgagccaaatgttgtctgccatcctgttgttgcttcagctgtgggacagcggggcacaggagactgacaatgagcgttccgcccagggcaccagcgccccacttttgcccttgctgcaaaggttccagagcatcatttgcaggaaggatgcaccccactccgagggcgacatgcaccttttgtctggccctctgagccccaatgagagtttcctgaggtacctcacccttccacaagacaacgagcttgccattgatctgcgacaaacggcggttgttgtcatggcccatttagaccgtctggctacgccctgtatgcctccgctgtgtagctctccgacatctcataagggatcattgcaagaggtcataggttgggggttaataggatggaaatactatgccaatgtgattggtccaatccagtgcgaaggcctggccaacctgggagtcacacagattgcctgtgcagagaagcgtttcctgattctgtcacgcaatggccgcgtgtacacacaggcctataatagtgacacgctggccccacagctggtccaaggccttgcctccagaaacattgtaaaaattgctgcccattctgatggtcaccactacctagccttggctgctactggagaggtgtactcctggggctgtggggacggcggacggctgggccatggggacactgtgcctttggaggagcctaaggtgatctccgccttctctggaaagcaggccgggaagcacgtggtgcacatcgcttgcgggagcacttacagtgcggccatcactgccgagggggagctgtacacctggggccgcgggaactacggccggctgggccatggctccagtgaggacgaggccattccgatgctggtagccgggcttaaaggactgaaggtcatcgatgtggcgtgtgggagtggggatgctcaaaccctggctgtcactgagaacgggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctggatctcctgcttcggcaggtgagtgaggggatggatggctccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggtatgg

SEQ ID NO: 139919 - DNA, 178 bp, Homo sapiens
  Payload ID: 7443
  Gene Symbol: HERC2
  Gene Name: HECT and RLD domain containing E3 ubiquitin protein ligase 2
  ENST ID: ENST00000619734
  CDS Start-End: 107-178
ccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacag

SEQ ID NO: 139920 - DNA, 4764 bp, Homo sapiens
  Payload ID: 7444
  Gene Symbol: HERC3
  Gene Name: HECT and RLD domain containing E3 ubiquitin protein ligase 3
  Uniprot ID: Q15034
  ENST ID: ENST00000264345
  CDS Start-End: 31-3183
ggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaact

SEQ ID NO: 139921 - DNA, 2634 bp, Homo sapiens
  Payload ID: 7444
  Gene Symbol: HERC3
  Gene Name: HECT and RLD domain containing E3 ubiquitin protein ligase 3
  Uniprot ID: Q15034
  ENST ID: ENST00000407637
  CDS Start-End: 167-1273
cgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctggtaagaatgattgtctctggaatttaaaggtattttaagtgatgaaaacagttgtttacagaatatgtatctattacttactttgaggtcttttggagggaatgaagataaggtattttttaacatcaattaataatttctgtacttactatgcatgaagctgtagagttgagatcctagagaataaataaagcaggaaatactgttgtgttaggccgttcttgcattgctgtaaagagcacctgaaacagggtgatttatgaagaaaagagttttaattggctcacagttctgcaggctctacagggagcatgatgcagccatctgcttggcttctggggaggcctcaggaatcttacagtcatggcagaaggcaaagaaggagcagacacttcacatggcagaagcaggagcaagaggaagagtggagaggaggtgccatactttttacaccaccagatctcatgtgaactcagagcaagagctcacttatcaccaaggggatggcccaagccattcatgagggatccgccctcatgatctaaacacataccaccatgcctcacctccaacattgggattactgcaattcaacatgagttttgaccagaacatacattcaaactataccagttattttgtttccacagaccttggtggtggtgtatacattttattgttgttgctaataatgacagttcgcatgtattgaatgcttaatgacgtttcattactatgcaaagcactcaaaataatctaagaactagttagtggttattatccccatgttagagataagggaacaaagtcttaaggaggtcaagtaatttgcccaagatcacatagattctggaggcaggatttaaacccaggtcattctaaatcatgtgtactatgttacctctactttgctgttggcattttggtatataacatgatgtgatttctttttaagccattttttttcttcccttaaaaaatagttaaatagcagtcttggtttcattggaaatcaaagtcaggcagtcattaatattgaatgactgcttcaccttgaaataataaatctgaggctgaaatggagctagagaatcattaaaaggaagtgtaacttattaattttgattttgaagtcgataaagtgacacacttatggcttgatcaggaatttgtttgaaacagtaaccatcataagttttagtactggattataagaaactcaaggacacagacaaactcttttcctttttgtaaacctagcatatagcacaggacctggcatgaacttgtcactcagtagacatttttggaatggatatatgagcatctgaaatgtagtgcaacttaaaatataaataaacaagattttgtctgggtgatgttcccagaagcaaaagaa

SEQ ID NO: 139922 - DNA, 4974 bp, Homo sapiens
  Payload ID: 7444
  Gene Symbol: HERC3
  Gene Name: HECT and RLD domain containing E3 ubiquitin protein ligase 3
  Uniprot ID: Q15034
  ENST ID: ENST00000402738
  CDS Start-End: 240-3392
ggtgcgaagccattcacccagcgcattccgccgcccgcaggcttgcggggaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 139923 - DNA, 559 bp, Homo sapiens
  Payload ID: 7444
  Gene Symbol: HERC3
  Gene Name: HECT and RLD domain containing E3 ubiquitin protein ligase 3
  ENST ID: ENST00000426683
  CDS Start-End: 175-559
gtgtgtacgggtgtgtgtgtgtgtgtacgccgacacgtcggtgcggaccgacgcgggggtgtcaggagctgggacggccgggggcagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgccca

SEQ ID NO: 139924 - DNA, 761 bp, Homo sapiens
  Payload ID: 7444
  Gene Symbol: HERC3
  Gene Name: HECT and RLD domain containing E3 ubiquitin protein ligase 3
  ENST ID: ENST00000431413
  CDS Start-End: 367-761
attcacccagcgcattccgccgcccgcaggcttgcggggaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtgagttaattctgcattttagttttggccctacatttatttaaagcctgaatttggggagtatctgcaaagcactgaaggttttggacattgtcttttcctgctgttgaaagagaccctcttcatatatacaacattcaggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaataca

SEQ ID NO: 139925 - DNA, 887 bp, Homo sapiens
  Payload ID: 7444
  Gene Symbol: HERC3
  Gene Name: HECT and RLD domain containing E3 ubiquitin protein ligase 3
  ENST ID: ENST00000452979
  CDS Start-End: 205-887
ccagggcaaccagaccgagaggagcatgtgtaacctgaaacaggtgagcctatggagacagtacctaatgcgactgtgcacggaatatgtgtatgcagcatgagctccagggaataaaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaa

SEQ ID NO: 139926 - DNA, 579 bp, Homo sapiens
  Payload ID: 7444
  Gene Symbol: HERC3
  Gene Name: HECT and RLD domain containing E3 ubiquitin protein ligase 3
  ENST ID: ENST00000422770
  CDS Start-End: 298-579
ttattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtgttttggccctacatttatttaaagcctgaatttggggagtatctgcaaagcactgaaggttttggacattgtcttttcctgctgttgaaagagaccctcttcatatatacaacattcaggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcc

SEQ ID NO: 139927 - DNA, 836 bp, Homo sapiens
  Payload ID: 7444
  Gene Symbol: HERC3
  Gene Name: HECT and RLD domain containing E3 ubiquitin protein ligase 3
  ENST ID: ENST00000512194
  CDS Start-End: 1-836
gtaaatcttaaagtgaagcatgtggaatatgatacattttacattcctgagatttccaatctcgtggacattcaggaagactacctcatgtggttcttgcatcaagcagggatggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacag

SEQ ID NO: 139928 - DNA, 582 bp, Homo sapiens
  Payload ID: 7444
  Gene Symbol: HERC3
  Gene Name: HECT and RLD domain containing E3 ubiquitin protein ligase 3
  ENST ID: ENST00000513325
  CDS Start-End: 349-582
aggaaacgctgccgaggagtaggcggggcgggcgctttggttccgagggtgcttctgctccgactgcttttcccacgggcgtcatctatagtccggaggacagccccagggcagaggcctctgaactgcaaggtgtggaatatttctggcttctagtccaatgccaagtgtgtgacctgtgagttaattctgcattttagttttggccctacatttatttaaagcctgaatttggggagtatctgcaaagcactgaaggttttggacattgtcttttcctgctgttgaaagagaccctcttcatatatacaacattcaggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaatt

SEQ ID NO: 139929 - DNA, 4371 bp, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENST ID: ENST00000277817
  CDS Start-End: 496-3339
gtggttagtagcgataaatgctctgaaggaaaaaacatacagtactgtgagaatgtagtattttgaaatgtttcatttgcaaaattgtacttgatactcagaatagtgtttttttttcctaaaatacttaatatgctgaacaggtcaatgtatcatctgcctagtatgcataaacaataacagtaaatgtttagtaatttgagcacagttgggtatgttcatgtattttttattccttactctgtttgcattgccagtgtttgattttgctatttcaaagaaatggcattttgttgagtttgaaaatttgaaggtgcattggatcctgctaatttgttggattctgctaaattgtagcagtacagctctcaggttttgtagttaagagcataacttcactaaataaaaatatttttaatacaataatatggaatcagagtaactctcctttttcctgctcaaactttgatttgctgaagctgcttcccgaaaatcatgtgtgtcgactctctggtcagaatttgctccggactctcttatggcagaatcagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatatttaaactttca

SEQ ID NO: 139930 - DNA, 3905 bp, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENST ID: ENST00000373700
  CDS Start-End: 314-3463
acttccggccagcccctcccccgcctccctcgcgtggccacctccccctctgccttctcctacccagtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctga

SEQ ID NO: 139931 - DNA, 4445 bp, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENST ID: ENST00000395198
  CDS Start-End: 249-3422
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatattt

SEQ ID NO: 139932 - DNA, 6391 bp, Homo sapiens
  Payload ID: 7445
  Gene Symbol: HERC4
  Gene Name: HECT and RLD domain containing E3 ubiquitin protein ligase 4
  ENST ID: ENST00000427635
  CDS Start-End: 1-1198
gggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgaggcgaggtcttgccatgttgtccaggctggtcttgaactcctgggctcaagtgatcctcctaccttggcttcccaaagtgctgggattacagtgaatgagcatcaatgcctactaccaccacaaaaaagaactcagtgaaaattcttctcaaaggaattatgtgtttcctgatggaactactctcctgcctccatgtagtagttttactgaaataaccaaatggtgattgaaacctgtctagattcaaccaccaatttacagaacagaagaccaagccaaatgttaggagaaaccacaaagataaagtcagcaaaatccagtctgcataaagttgtacaggacaaatgactaggtttctcaaactttttcgagtagtgattaaaaggaaattaaggataggatgcagtggctcacacctgtaatcccagcactttgggaggctgaggtgggcagatcacttgaggtcaggagttcgagaccagcctgaccaaaatggtgaaaccccatctgtactaaatacaaaaattagatgtggtggtgggcgcctgtaatctcagttactcgggaggctgaggttgcagtaagccgagatcatgccactgcactccaacccgggcgacagagtgagacctgtctcaaaaaataaaaataaggccaggtgcagtggctcacacctgtaattctgacactttgggaggctgaggtgggcggatcacctgaggttgggagttcgagaccagcctgaccaacatggagaaaccccgtctctactaaaaataaaaaattaatcaggagtggtggcccatgcctgtaatcccagctaattgggaggctgaggtgggacaatcgcttgaacttgggagatggaggttgcggtgaaccaagatcgcgccactgcactccagcctgggcaacaagagtgaaactccgtctcaaaaaagaaataaataaaaataaaaaaaggaaattaaggaaacttaacttttggtacctaactcatagcctccagaaacccattcatgtactgtagattagtcaaccatcttgtagggaattgtttatagagggcacaatcacattttaagagtaaataaataacatcctgctaaatcttttgaggaaatgagcaattccatatagatttgtgagaattatttagaaaaaagattttaggttgaataattggcttatttaataaagatttacccttttattctattcttaaaacttgtttttggccttagggtattcttgtgacttacggaaaatttgatagtaattatcaaattattgttctaaactctgaagctcatttttggtataacctagataacaattgcatatttgtatggacaggtatttactgatttcttttacaaataaaacattgtgcttgcttgtaaggaataatcaaggaaattaacatgtggtcatttccttgaaaagaatggataattctatagcagccatggtcacaaataatacaaggtgaagaattagtcaactaaggaatgggaataggataacagggatagactatggactagccaagcaatatttttggtaatagatactctttccagtttggggagcagaagaaaagaaaaaaaagaggcccggaatatctttttcaaaagaaactttgttgccctttctttattcctaataaatttgcttattaatgtattcactttggggcctaatttggcttttactgacaaatagctgccaacaaagagctgtatgtattatcttgtacacctatattgaaaaaaaaaattctgcattatgaaatatttactccagaagttttaatttttgtttgctgtttctttttaagaataattttttttttttttagagatgggtcttgctatgttgcttgctggagtgcagtggctagtcacagatgcagtcatagcatactgcagctttgaactgggctcacgccatcctcctgcctcactctcccaagtagctgggactacagacatgtgccactgtagcccagttcaattctttcttttttttttttttttgaggtggagtcttatgctctggcccaggctggagtgcagtggggtgatctcggctcactgcaacctccgcctcctgggttcaagcgattctcctgtctcagcctcccaagtagctgggattacaggcacacaccaccacgcctggctaatttttgtatttttagtagagatggggtttcactatattggccaggctggcgtcgaactcctaacatcaaatgatcctcccacctcagcctcccaaagtgctgggattacaggcatgagccactgtgcctcgccaagaataaatactcttgatttttatttccttctagctatcttttgtagcttttgttctattttttttaaatcatctttggtttaaactgaaatatactgagatgcagattagaaaaagctttttttcttggtgcagggcagaagaaaggcttgtaaacttcaccaaatgctgcttatgcttgtgggatcgtttaatgttcatcatttggtcagtctcatccccatagcagtcagaatatttcaagtcactttataccatgaagtccatgaatgggaggccttattaaataagatgattatgtgaaaatctaatggcatattgatgctctgaaatatgttatgtaaatcttggcttttaattttttacatttttattacagattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacataggtgtaacaaatagtaccctttacacttgtagcagttcaaagttatatgaagaagtagactctgagctgtttcattaaagatggattttcatccctgacagttggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 139933 - DNA, 4211 bp, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENST ID: ENST00000412272
  CDS Start-End: 249-3188
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatattt

SEQ ID NO: 139934 - DNA, 3385 bp, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENST ID: ENST00000492996
  CDS Start-End: 249-581
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagtttcgctcttgtttcccaggccggagtgcaatggcgccatctcggctcaccgcaacctctgcctcccaggttcaagcaattctcctgcctcagcctcccgaatagctgggattacaggcgcccaccacaatgcctggctacttttcatattttaatggagatggggttttaccatgttggccaggctggtctcgaactcctgacctcaggtgatccgcctgccttggcctcccgaagtgctggaattacaggcatgagccactgctcctggcctaagatgttttttaaataatgtttttaactaaattttaagaatgtttttaactaaagttatttatatttggaataattcgttaatgatttgtgtcatttccccaacccctttttaaatttgtgaatttgaggactggattaaaagataaaaagttgttggatcttatttattttaaagtcttctggtaattgagcaagttggttatatttctgggacaatgtaataaacatagttcatttcccaggaggtttttgttttgttttgttttgtttcgttttgtttgagacagagtctcactctgttgcccaggctggaatgcagtggcacgatctctgctcactgcaacctccgcctcccaggttcaagcgattctcctgcctcggcctcccgagtaggtgggactataggggcgtgccaccatgcccgggtaattttttatatttttagtagggacggggtttcaccgtgttagccaggatggtcttgatatcctgaccttgtgatctgcccgccttggcctcccagagtgctgggattacaggcgtgagccaccgtgcccagctgacttcacaagaactttaaacttgtgtcagaaagcacatggaatggagggaactaagaattgtttctttacataggttggctttataaatatacatattccataactaataaggaatgaaggagaaagaggtagccttattaaggataaattattctcgagattcataataacctactggaggacttggcctgacaatgtagtgaatagatttaacctgtggcctattgaaaagaggtgtttctgttctggactttttagggaccacacagaaagatttaactgaattcctttattatactaaaggtgcagattatgttcatgttcatctctgttgtcttgtatatgtatgtccttttctatcactactggcttttctgaattatttccagagaagtgaatgtctgtttcactttcatgtttttttcttcataagaactttaaaatactttttaagctaatgtctcaatttttaaatttatagctaacaaatatatttaatcttcagtgcgctagaccaatccatttaaatgaattgttgtttttttatactttcaaattcagttctgaagattttaagtatgggaagtatacttttctttacaagatccttttcttactgtgtatctaatcataggtataatttggtgaccatggttatgttttgcacattgatttccatttgtttcatgttagaaacagtactaaactgttctgtgaccataatttgtaaataaagtggtgttctgtttaaaaacaagccctgttatctaaaaaacagttttttgtgttttacaacattctttcaaatggagtatctcatttaattctcacaacagttgtatgtagctaaggcaggtatcatggtccgcattttacagatgaggacactgaggttaaaagagattaagagactaatagggtcacttggctagcacatcttgagaccaccctaaatcttgtggtttttatccttaatctcacaaatcttttcctttgctacatttagaaggtaaaagaatatttgttcacctttgaggaagctggtttccatcagtattttattgtaattctgagggttttttattttttatatttttttgagatggggtcttattctgttgcttagggtagagtgcagtggcgtgataatagctcactgtagccttggactcctgggctcaagtgatcctcctgcctcagcttccccagtagttgggactacacttatgtgccaccatgcctggctaattttttttttttttttttttttttgaaacggagtcttgctctgttacccaggctggcgtgcagtggtgtgatctctgctcactgcagcctccacctcccaggttcaagtgattctcctgtctcagcctcccgagtagctgggactacaggtgtgtgccaccacacctggctaatttttttgtagttttagtagagacagggtttcaccatgttggccaggggggtctcgaactcctgacctcaggtgatctgcccacctcggtctcccaaagtgctgggattacaggcatgagccaccaggcctggccaatttttttatgtttgttagagaagggggtctccctatgttgcccagtctggtctcaaactccagtcctcaagctatcctcctgtcctggcttccccaaattgctgggatttatagggatgagctactgtggcagccaagaaaaatctttaaaaaattactatcttataactaagcttatacaatgaagacagcatattttattgtcttcccccttgtacacaaacttaaaaatcattttaagaactgataagaagatcgagagttctattttcaagatgtaatattgtaccaacaaaagctaaaaaattcaaatatgtatagtgtattactgaatggaagactaactcgattggcagagtttataggtaatagttttaatagtatgataaaatttattgtggtttatgttgaactctttttaaagatgatgagcattgattctttgttttccatatcctcgaatggtaatttctactgttgagtcattccaataaaagcattttggtcacata

SEQ ID NO: 139935 - DNA, 3593 bp, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENST ID: ENST00000473533
  CDS Start-End: 249-602
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgatacca

SEQ ID NO: 139936 - DNA, 540 bp, Homo sapiens
  Payload ID: 7445
  Gene Symbol: HERC4
  Gene Name: HECT and RLD domain containing E3 ubiquitin protein ligase 4
  ENST ID: ENST00000506515
  CDS Start-End: 453-540
agtgtgctggaaagttctacagatttcgccatcagactatccattcctattcttgaaaaatctgcagtgctggagttatttgcaattcccccccgccaatctttaaataattgtctcagagatatagatagatatagattgcccacgggtgatttttttaatcccggttaccacttgtaataaaagaggttgaattttggagagaattgatatttaaattgcatgtttttttttctgtattataattatgcacattgatttagttttaaaattagtgaggttggaatgttagtattttgatttgaaatctgggatctttggaggtgatttaagattatggtttgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgact

SEQ ID NO: 139937 - DNA, 944 bp, Homo sapiens
  Payload ID: 7445
  Gene Symbol: HERC4
  Gene Name: HECT and RLD domain containing E3 ubiquitin protein ligase 4
  ENST ID: ENST00000513996
  CDS Start-End: 223-944
ctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagctgcttcccgaaaatcatgtgtgtcgactctctggtcagaatttgctccggactctcttatggcagaatcagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaa

SEQ ID NO: 139938 - DNA, 3513 bp, Homo sapiens
  Payload ID: 7446
  Gene Symbol: HERC5
  Gene Name: HECT and RLD domain containing E3 ubiquitin protein ligase 5
  Uniprot ID: Q9UII4
  ENST ID: ENST00000264350
  CDS Start-End: 154-3228
tcagtagctgaggctgcggttccccgacgccacgcagctgcgcgcagctggttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgaaatgcattaaattaggaaaaaacatgaagatacattccgtggaccaaggagcagagcacatgctgattctctcatcagatggaaaaccatttgagtatgacaactatagcatgaaacatctaaggtttgaaagcattttacaagaaaaaaaaataattcagatcacatgtggagattaccattctcttgcactctcaaaaggtggtgagctttttgcctggggacagaacctgcatgggcagcttggagttggaaggaaatttccctcaaccaccacaccacagattgtggagcacctcgcaggagtacccttggctcagatttctgccggagaagcccacagcatggccttatccatgtctggcaacatttattcatggggaaaaaatgaatgtggacaactaggcctgggccacactgagagtaaagatgatccatcccttattgaaggactagacaatcagaaagttgaatttgtcgcttgtggtggctctcacagtgccctactcacacaggatgggctgctgtttactttcggtgctggaaaacatgggcaacttggtcataattcaacacagaatgagctaagaccctgtttggtggctgagcttgttgggtatagagtgactcagatagcatgtggaaggtggcacacacttgcctatgtttctgatttgggaaaggtcttttcctttggttctggaaaagatggacaactgggaaatggtggaacacgtgaccagctgatgccgcttccagtgaaagtatcatcaagtgaagaactcaaacttgaaagccatacctcagaaaaggagttaataatgattgctggagggaatcaaagcattttgctctggataaagaaagagaattcatatgttaatctgaagaggacaattcctactctgaatgaagggactgtaaagagatggattgctgatgtggagactaaacggtggcagagcacaaaaagggaaatccaagagatattttcatctcctgcttgtctaactggaagttttttaaggaaaagaagaactacagaaatgatgcctgtttatttggacttaaataaagcaagaaacatcttcaaggagttaacccaaaaggactggattactaacatgataaccacctgcctcaaagataatctgctcaaaagacttccatttcattctccaccccaagaagctttagaaattttcttccttctcccagaatgtcctatgatgcatatttccaacaactgggagagccttgtggttccatttgcaaaggttgtttgtaaaatgagtgaccagtcttcactggttctggaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaaaccaggtgaaatgtcaactacctgaaagtattttccaagtagacgaactcttgcaccgtctcaatttttttgtagaagtatgcagaaggtacttgtggaaaatgactgtggacgcttcagaaaatgtacaatgctgcgtcatattcagtcactttccatttatctttaataatctgtcgaaaattaaactactacatacagacacacttttaaaaatagagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaagcctaaatttgagaagaaaagatacttcttttttggggttctatgtggactttccctgttcaattgcaatgttgccaaccttcctttcccactggcactgtttaagaaacttttggaccaaatgccatcattggaagacttgaaagaactcagtcctgatttgggaaagaatttgcaaacacttctggatgatgaaggtgataactttgaggaagtattttacatccattttaatgtgcactgggacagaaacgacacaaacttaattcctaatggaagtagcataactgtcaaccagactaacaagagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaagaatgcacgttatgaaccaggatataacagttcacatcccaccatagtgatgttttggaaggctttccacaaattgactctggaagaaaagaaaaaattccttgtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaattaa

SEQ ID NO: 139939 - DNA, 2243 bp, Homo sapiens
  Payload ID: 7446
  Gene Symbol: HERC5
  Gene Name: HECT and RLD domain containing E3 ubiquitin protein ligase 5
  ENST ID: ENST00000508159
  CDS Start-End: 111-2099
aaagcttagtggtgacctcaagtaacaaaatctactcatttcttgtaggaaaacgaacagagttatttccttaagcagcataaagccatacctcagaaaaggagttaataatgattgctggagggaatcaaagcattttgctctggataaagaaagagaattcatatgttaatctgaagaggacaattcctactctgaatgaagggactgtaaagagatggattgctgatgtggagactaaacggtggcagagcacaaaaagggaaatccaagagatattttcatctcctgcttgtctaactggaagttttttaaggaaaagaagaactacagaaatgatgcctgtttatttggacttaaataaagcaagaaacatcttcaaggagttaacccaaaaggactggattactaacatgataaccacctgcctcaaagataatctgctcaaaagacttccatttcattctccaccccaagaagctttagaaattttcttccttctcccagaatgtcctatgatgcatatttccaacaactgggagagccttgtggttccatttgcaaaggttgtttgtaaaatgagtgaccagtcttcactggttctggaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaaaccaggtgaaatgtcaactacctgaaagtattttccaagtagacgaactcttgcaccgtctcaatttttttgtagaagtatgcagaaggtacttgtggaaaatgactgtggacgcttcagaaaatgtacaatgctgcgtcatattcagtcactttccatttatctttaataatctgtcgaaaattaaactactacatacagacacacttttaaaaatagagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaagcctaaatttgagaagaaaagatacttcttttttggggttctatgtggactttccctgttcaattgcaatgttgccaaccttcctttcccactggcactgtttaagaaacttttggaccaaatgccatcattggaagacttgaaagaactcagtcctgatttgggaaagaatttgcaaacacttctggatgatgaaggtgataactttgaggaagtattttacatccattttaatgtgcactgggacagaaacgacacaaacttaattcctaatggaagtagcataactgtcaaccagactaacaagagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaagaatgcacgttatgaaccaggatataacagttcacatcccaccatagtgatgttttggaaggctttccacaaattgactctggaagaaaagaaaaaattccttgtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcag

SEQ ID NO: 139940 - DNA, 15137 bp, Homo sapiens
  Payload ID: 7447
  Gene Symbol: HERC1
  Gene Name: HECT and RLD domain containing E3 ubiquitin protein ligase family member 1
  Uniprot ID: Q15751
  ENST ID: ENST00000443617
  CDS Start-End: 89-14674
cctctgcggagccgggctcgggtcgccggagccgcgccccaccccgccagctccagagccacgactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctctgttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccgatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggaggcaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagaggtactggattggcctacctggcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccgtactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggagcaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctccctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcatagaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgga

SEQ ID NO: 139941 - DNA, 495 bp, Homo sapiens
  Payload ID: 7447
  Gene Symbol: HERC1
  Gene Name: HECT and RLD domain containing E3 ubiquitin protein ligase family member 1
  ENST ID: ENST00000559715
  CDS Start-End: 1-495
taggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacag

SEQ ID NO: 139942 - DNA, 539 bp, Homo sapiens
  Payload ID: 7447
  Gene Symbol: HERC1
  Gene Name: HECT and RLD domain containing E3 ubiquitin protein ligase family member 1
  ENST ID: ENST00000560897
  CDS Start-End: 1-81
aattcagatgaccttcatgtgctgacagttatttcagccttacaagactttaaaggacatcttcatcagagttctttgtgacttggagagagaacacctttggagaaaccactgtacaagcccccggcttgctcattaactgaactcataatgactctgaagcctacaaagagagcaccgacggtttttttaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctg

SEQ ID NO: 139943 - DNA, 647 bp, Homo sapiens
  Payload ID: 7447
  Gene Symbol: HERC1
  Gene Name: HECT and RLD domain containing E3 ubiquitin protein ligase family member 1
  ENST ID: ENST00000560462
  CDS Start-End: 212-647
caaaaataaaggacgcgaccgccgcagcctctgcggagccgggctcgggtcgccggagccgcgccccaccccgccagctccagagccacgtacgaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctg

SEQ ID NO: 139944 - DNA, 577 bp, Homo sapiens
  Payload ID: 7447
  Gene Symbol: HERC1
  Gene Name: HECT and RLD domain containing E3 ubiquitin protein ligase family member 1
  ENST ID: ENST00000560316
  CDS Start-End: 518-577
ctgcggagccgggctcgggtcgccggagccgcgccccaccccgccagctccagagccacgtacgatggagtctccctctgtcgccaggctggagtgcagtcttgtgatctcggctcactgcaacctccacctcccgggttcgagcgattctcctgcctctgcctcccaagtagctgggactacaggcgcgcaccaccactactggctaatttttgtatttttattaaagacggggtttcaccatgttggcaaggatggtctccatctcttgacctcgtgatcctcccacctcgacctccaaaagtgctgggattacaggcgtgagccaccgtgcctggcctgaataatatcatcttaaacttttgggacttgccttaccagtcatcagaacatttatacatttataagcctattgtaatcaagtcactgttgtaagaatagacaagtggaccagaatagagaatccagaaatagatcctgttagtggaaaagactaatggctgaaggataaatcaacatggcaactatgattccaccagtgaagctgaaatggcttgaacacttgaacagctcctgg

SEQ ID NO: 139945 - DNA, 581 bp, Homo sapiens
  Payload ID: 7447
  Gene Symbol: HERC1
  Gene Name: HECT and RLD domain containing E3 ubiquitin protein ligase family member 1
  ENST ID: ENST00000558532
  CDS Start-End: 123-581
agcaaaaataaaggacgcgaccgccgcagcctctgcggagccgggctcgggtcgccggagccgcgccccaccccgccagctccagagccacgtacggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagc

SEQ ID NO: 139946 - DNA, 828 bp, Homo sapiens
  Payload ID: 7447
  Gene Symbol: HERC1
  Gene Name: HECT and RLD domain containing E3 ubiquitin protein ligase family member 1
  ENST ID: ENST00000558324
  CDS Start-End: 1-458
aagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccaggtaacagactggcgtggtaagcagccaggcacagactggcttgaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgca

SEQ ID NO: 139947 - DNA, 551 bp, Homo sapiens
  Payload ID: 7447
  Gene Symbol: HERC1
  Gene Name: HECT and RLD domain containing E3 ubiquitin protein ligase family member 1
  ENST ID: ENST00000561359
  CDS Start-End: 1-143
gaaattccactgcaaaatcttcacctcagaaaattgacgtcctttgtggaattggaataaaaaaggttgcttgtggaactcagttttctgttgctttgaccaaagatggtcatgtgtatacctttggtcaaggtggtgagtagtcactatgacctcctttcagtatagataattttccacttctctttcatgtgctttattataaagacaaactcccctccccattaagaccccttatgccagagccagcactcttgctagaagagtccctgccaagggccgtcccctcttcttttctactgcccttgacatgctgccacaaatactgccttgaccatcagagctcctctgtgtcctgcctcattcttcatcccttctagggactggggctgcagatcttaggaactggaggaattcataggcactctgggttcaaatcttgagtagatcgcctgataggcttgccagaggggcgtgctcgcaatcacaatcgaccgcaacaaatccctgtcctggctggagtaatcatagaagatgtggcagttggagct

SEQ ID NO: 139948 - DNA, 2215 bp, Homo sapiens
  Payload ID: 7447
  Gene Symbol: HERC1
  Gene Name: HECT and RLD domain containing E3 ubiquitin protein ligase family member 1
  ENST ID: ENST00000561400
  CDS Start-End: 143-2215
ccctttgacaagtcgctgctgctgcagcaaaaataaaggacgcgaccgccgcagcctctgcggagccgggctcgggtcgccggagccgcgccccaccccgccagctccagagccacgactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggaggcaagggagagagtggccgattgcatcactatcag

SEQ ID NO: 139949 - DNA, 3779 bp, Homo sapiens
  Payload ID: 7448
  Gene Symbol: HERC6
  Gene Name: HECT and RLD domain containing E3 ubiquitin protein ligase family member 6
  Uniprot ID: Q8IVU3
  ENST ID: ENST00000264346
  CDS Start-End: 60-3128
ggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagttatcacaccctggcatatgtgcacaccactggtcaggtggtatcttttggtcatggaccaagtgacacaagcaagccaactcatccggaggccctgacagagaactttgacattagctgcctgatttctgctgaagacttcgtggatgttcaagtcaaacacatttttgctggaacatatgccaactttgtgacaactcatcaggatactagttccacacgtgctcccgggaaaaccctgccagaaataagccgaattagccagtccatggcagaaaaatggatagcagtgaaaagaagaagtactgaacatgaaatggctaaaagtgaaattagaatgatattttcatctcctgcttgtctgactgcaagttttttaaagaaaagaggaactggagaaacgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaaagaagtgttgggcatttttgcaagaatcttctctgaatccgctgatccagatgcttaaagcagccatcatctctcagctgcttcatcagactaaaaccgaacaggatcactgtaatgttaaagctcttttaggaatgatgaaagaactgcataaggtaaacaaagctaactgtcgactaccagaaaatactttcaacataaatgaactctccaacttattaaacttttatatagatagaggaagacagctctttcgggataaccacctgatacctgcagaaacccccagtcctgttattttcagtgattttccatttatctttaattcgctatccaaaattaaattattgcaagctgattcacatataaagatgcagatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccacccattcatgcatgtcgc

SEQ ID NO: 139950 - DNA, 3473 bp, Homo sapiens
  Payload ID: 7448
  Gene Symbol: HERC6
  Gene Name: HECT and RLD domain containing E3 ubiquitin protein ligase family member 6
  ENST ID: ENST00000273960
  CDS Start-End: 184-1152
agcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagacttcgtggatgttcaagtcaaacacatttttgctggaacatatgccaactttgtgacaactcatcagtgaaattagaatgatattttcatctcctgcttgtctgactgcaagttttttaaagaaaagaggaactggagaaacgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaataaacaaagctaactgtcgactaccagaaaatactttcaacataaatgaactctccaacttattaaacttttatatagatagaggaagacagctctttcgggataaccacctgatacctgcagaaacccccagtcctgttattttcagtgattttccatttatctttaattcgctatccaaaattaaattattgcaagctgattcacatataaagatgcagatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccaccc

SEQ ID NO: 139951 - DNA, 3781 bp, Homo sapiens
  Payload ID: 7448
  Gene Symbol: HERC6
  Gene Name: HECT and RLD domain containing E3 ubiquitin protein ligase family member 6
  Uniprot ID: Q8IVU3
  ENST ID: ENST00000380265
  CDS Start-End: 184-3144
agcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagttatcacaccctggcatatgtgcacaccactggtcaggtggtatcttttggtcatggaccaagtgacacaagcaagccaactcatccggaggccctgacagagaactttgacattagctgcctgatttctgctgaagacttcgtggatgttcaagtcaaacacatttttgctggaacatatgccaactttgtgacaactcatcaggatactagttccacacgtgctcccgggaaaaccctgccagaaataagccgaattagccagtccatggcagaaaaatggatagcagtgaaaagaagaagtactgaacatgaaatggctaaaagtgaaattagaatgatattttcatctcctgcttgtctgactgcaagttttttaaagaaaagaggaactggagaaacgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaaagaagtgttgggcatttttgcaagaatcttctctgaatccgctgatccagatgcttaaagcagccatcatctctcagctgcttcatcagactaaaaccgaacaggatcactgtaatgttaaagctcttttaggaatgatgaaagaactgcataaggtaaacaaagctaactgtcgactaccagaaaatactttcaacataaatgaactctccaacttattaaacttttatatagatagaggaagacagctctttcgggataaccacctgatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccaccca

SEQ ID NO: 139952 - DNA, 557 bp, Homo sapiens
  Payload ID: 7448
  Gene Symbol: HERC6
  Gene Name: HECT and RLD domain containing E3 ubiquitin protein ligase family member 6
  ENST ID: ENST00000502870
  CDS Start-End: 1-557
gagacaacagcaggggtcagctgggccgcaggggcgcgcagcgcggggagctgccagtggtggttggggggtgttttgttttgtttcccaaagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtccca

SEQ ID NO: 139953 - DNA, 517 bp, Homo sapiens
  Payload ID: 7448
  Gene Symbol: HERC6
  Gene Name: HECT and RLD domain containing E3 ubiquitin protein ligase family member 6
  ENST ID: ENST00000504905
  CDS Start-End: 12-233
gcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgc

SEQ ID NO: 139954 - DNA, 4576 bp, Homo sapiens
  Payload ID: 7449
  Gene Symbol: HACE1
  Gene Name: HECT domain and ankyrin repeat containing E3 ubiquitin protein ligase 1
  Uniprot ID: Q8IYU2
  ENST ID: ENST00000262903
  CDS Start-End: 278-3007
agaaggccacgcgagcccgggagggacgcggcggcgggggctgcaggaaaggcgcgagcagaggcggcggcgggtgtactgtaggtggtcggtccggcagcagcccggcccccggacgcaggacgtggccccaggcagccctcgcagctcagtgctctagccggggcaagcccgcgtctccgcctgctggacgggcccaggcgagatgtagggctctgggcgcggaggccgccggtggggcggctgatcgcggaggatcgcggagggcgcgccgaggatggagagagcgatggagcaactcaaccgcctgacgcgctcgctgcgccgcgcgcgcaccgtggagttgcccgaggataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaatacattggctggctgtgaatgggcggacagaactactccatgaccttgtgcagcatgtcagtgatgttgatgttgaggatgccatggggcagacagcactgcatgttgcctgccagaacggtcacaagacgacagtgcagtgcttgctagacagtggtgctgatattaacaggccaaatgtatcaggagcaactccattgtactttgcttgcagtcatggtcagagagatacagcacagatcctactattacgaggagccaaatatctgccagataaaaatggagtaactcctctggatttatgtgtacagggtggatatggagagacttgtgaagtattaattcaatatcacccgaggctttttcagactattattcaaatgacacagaatgaagacctccgagaaaacatgttacggcaagttctggagcatttgtctcagcaaagtgaaagccagtacctaaagattctaacaagccttgctgaagttgctacaacaaatggtcataaactgcttagcctctctagcaattatgatgctcaaatgaagagccttttaaggattgtgagaatgttttgtcacgtctttcgaattggtccatcctcccccagtaatggaattgatatgggctacaatgggaataaaactccaagaagccaggtgttcaagcctctggaattgctttggcactcgttagatgaatggctagttttaatagccacagaattgatgaaaaacaaaagagactcaacagagatcacttctattttactgaaacaaaaaggccaagatcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaaaagttaccattagctctaaaattaagattcggatgctttatttatagtaactgaagctaataatgttttatgttttgattttttgaaatttaattgtagaagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataactgag

SEQ ID NO: 139955 - DNA, 3102 bp, Homo sapiens
  Payload ID: 7449
  Gene Symbol: HACE1
  Gene Name: HECT domain and ankyrin repeat containing E3 ubiquitin protein ligase 1
  Uniprot ID: Q8IYU2
  ENST ID: ENST00000369125
  CDS Start-End: 278-2362
agaaggccacgcgagcccgggagggacgcggcggcgggggctgcaggaaaggcgcgagcagaggcggcggcgggtgtactgtaggtggtcggtccggcagcagcccggcccccggacgcaggacgtggccccaggcagccctcgcagctcagtgctctagccggggcaagcccgcgtctccgcctgctggacgggcccaggcgagatgtagggctctgggcgcggaggccgccggtggggcggctgatcgcggaggatcgcggagggcgcgccgaggatggagagagcgatggagcaactcaaccgcctgacgcgctcgctgcgccgcgcgcgcaccgtggagttgcccgaggataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaatacattggctggctgtgaatgggcggacagaactactccatgaccttgtgcagcatgtcagtgatgttgatgttgaggatgccatggggcagacagcactgcatgttgcctgccagaacggtcacaagacgacagtgcagtgcttgctagacagtggtgctgatattaacaggccaaatgtatcaggagcaactccattgtactttgcttgcagtcatggtcagagagatacagcacagatcctactattacgaggagccaaatatctgccagataaaaatggagtaactcctctggatttatgtgtacagggtggatatggagagacttgtgaagtattaattcaatatcacccgaggctttttcagactattattcaaatgacacagaatgaagacctccgagaaaacatgttacggcaagttctggagcatttgtctcagcaaagtgaaagccagtacctaaagattctaacaagccttgctgaagttgctacaacaaatggtcataaactgcttagcctctctagcaattatgatgctcaaatgaagagccttttaaggattgtgagaatgttttgtcacgtctttcgaattggtccatcctcccccagtaatggaattgatatgggctacaatgggaataaaactccaagaagccaggtgttcaagcctctggaattgctttggcactcgttagatgaatggctagttttaatagccacagaattgatgaaaaacaaaagagactcaacagagatcacttctattttactgaaacaaaaaggccaagatcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacaggcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttacc

SEQ ID NO: 139956 - DNA, 4729 bp, Homo sapiens
  Payload ID: 7449
  Gene Symbol: HACE1
  Gene Name: HECT domain and ankyrin repeat containing E3 ubiquitin protein ligase 1
  ENST ID: ENST00000416605
  CDS Start-End: 236-772
gcaggaaaggcgcgagcagaggcggcggcgggtgtactgtaggtggtcggtccggcagcagcccggcccccggacgcaggacgtggccccaggcagccctcgcagctcagtgctctagccggggcaagcccgcgtctccgcctgctggacgggcccaggcgagatgtagggctctgggcgcggaggccgccggtggggcggctgatcgcggaggatcgcggagggcgcgccgaggatggagagagcgatggagcaactcaaccgcctgacgcgctcgctgcgccgcgcgcgcaccgtggagttgcccgaggataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaatacattggctggctgtgaatgggcggacagaactactccatgaccttgtgcagcatgtcagtgatgttgatgttgaggatgccatggggcagacagcactgcatgttgcctgccagaacggtcacaagacgtagagacggggtttcaccgtgttagccaggatggtctcaatctcctgacgtcgtgatctgcccgcctcggcctccctaagtgttgggattacagacagtgcagtgcttgctagacagtggtgctgatattaacaggccaaatgtatcaggagcaactccattgtactttgcttgcagtcatggtcagagagatacagcacagatcctactattacgaggagccaaatatctgccagataaaaatggagtaactcctctggatttatgtgtacagggtggatatggagagacttgtgaagtattaattcaatatcacccgaggctttttcagactattattcaaatgacacagaatgaagacctccgagaaaacatgttacggcaagttctggagcatttgtctcagcaaagtgaaagccagtacctaaagattctaacaagccttgctgaagttgctacaacaaatggtcataaactgcttagcctctctagcaattatgatgctcaaatgaagagccttttaaggattgtgagaatgttttgtcacgtctttcgaattggtccatcctcccccagtaatggaattgatatgggctacaatgggaataaaactccaagaagccaggtgttcaagcctctggaattgctttggcactcgttagatgaatggctagttttaatagccacagaattgatgaaaaacaaaagagactcaacagagatcacttctattttactgaaacaaaaaggccaagatcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacaggtggccagtagttaaagggagaaacattttgtattgctgtacaaatgctattaagaggagcctctataatcagtcctgttttgtgaattatttatggaaatgcagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaaaagttaccattagctctaaaattaagattcggatgctttatttatagtaactgaagctaataatgttttatgttttgattttttgaaatttaattgtagaagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataac

SEQ ID NO: 139957 - DNA, 622 bp, Homo sapiens
  Payload ID: 7449
  Gene Symbol: HACE1
  Gene Name: HECT domain and ankyrin repeat containing E3 ubiquitin protein ligase 1
  ENST ID: ENST00000524020
  CDS Start-End: 209-622
cgggtcgcggggccaggctggccgcggggctgggggcggccagtggggcaggagctccggccgcgtcaaggtcgggtggaaaaactaactgaaagctgagaaaacgcccacttttactttccagagctgagaggcggccccgggccccgaactcccctggcccgacgctcccaccccggcagataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaatacattggctggctgtgaatgggcggacagaactactccatgaccttgtgcagcatgtcagtgatgttgatgttgaggatgccatggggcagacagcactgcatgttgcctgc

SEQ ID NO: 139958 - DNA, 1521 bp, Homo sapiens
  Payload ID: 7449
  Gene Symbol: HACE1
  Gene Name: HECT domain and ankyrin repeat containing E3 ubiquitin protein ligase 1
  ENST ID: ENST00000518402
  CDS Start-End: 1-901
ctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatat

SEQ ID NO: 139959 - DNA, 1608 bp, Homo sapiens
  Payload ID: 7449
  Gene Symbol: HACE1
  Gene Name: HECT domain and ankyrin repeat containing E3 ubiquitin protein ligase 1
  ENST ID: ENST00000518503
  CDS Start-End: 1-988
cataaaagcacagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagagctactgctttctggcatgccagaaattgatgtgagtgattggataaaaaatacagaatacacaagtggctatgaaagagaagatccagttattcagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatat

SEQ ID NO: 139960 - DNA, 859 bp, Homo sapiens
  Payload ID: 7449
  Gene Symbol: HACE1
  Gene Name: HECT domain and ankyrin repeat containing E3 ubiquitin protein ligase 1
  ENST ID: ENST00000519645
  CDS Start-End: 238-859
ctgcaggaaaggcgcgagcagaggcggcggcgggtgtactgtaggtggtcggtccggcagcagcccggcccccggacgcaggacgtggccccaggcagccctcgcagctcagtgctctagccggggcaagcccgcgtctccgcctgctggacgggcccaggcgagatgtagggctctgggcgcggaggccgccggtggggcggctgatcgcggaggatcgcggagggcgcgccgaggatggagagagcgatggagcaactcaaccgcctgacgcgctcgctgcgccgcgcgcgcaccgtggagttgcccgaggataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaacagtgcagtgcttgctagacagtggtgctgatattaacaggccaaatgtatcaggagcaactccattgtactttgcttgcagtcatggtcagagagatacagcacagatcctactattacgaggagccaaatatctgccagataaaaatggagtaactcctctggatttatgtgtacagggtggatatggagagacttgtgaagtattaattcaatatc

SEQ ID NO: 139961 - DNA, 561 bp, Homo sapiens
  Payload ID: 7449
  Gene Symbol: HACE1
  Gene Name: HECT domain and ankyrin repeat containing E3 ubiquitin protein ligase 1
  ENST ID: ENST00000521962
  CDS Start-End: 1-133
ctcgctgcgccgcgcgcgcaccgtggagttgcccgaggagctgagaggcggccccgggccccgaactcccctggcccgacgctcccaccccggcagagatgaggtctcactatgttccccaggctggtcttgaactcctgggctcaagtgatccgcaccctgctccccccaaagtgttgggattacagatgtgagccaccgcgcctggcctggggataatcttcttgaaaaaatgataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagca

SEQ ID NO: 139962 - DNA, 1866 bp, Homo sapiens
  Payload ID: 7449
  Gene Symbol: HACE1
  Gene Name: HECT domain and ankyrin repeat containing E3 ubiquitin protein ligase 1
  ENST ID: ENST00000517424
  CDS Start-End: 1-527
atcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacagccttttaaagatcgctgtgaatggttctatgaacatttgcattcaggacagccagattcagatatggtgcacaggccagtgaatgaaaatgatatcctgctggttcacagaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaa

SEQ ID NO: 139963 - DNA, 9134 bp, Homo sapiens
  Payload ID: 7450
  Gene Symbol: HECTD1
  Gene Name: HECT domain containing E3 ubiquitin protein ligase 1
  Uniprot ID: Q9ULT8
  ENST ID: ENST00000399332
  CDS Start-End: 490-8322
ggcttcttgggaactctagggccgcggccgggcctggctctgccggcggcctgttgggagctggatcggagcggtttggaacgacaagcccgagtaagagcctgcgggaaggggaggcgggagcgcctcggaccgtcggaagggccctgcgtgggggcgcggatcccggacgcccggcgagtggcggaaagcgagaccccggcgccgagtgaggtcggccaggctgctgccgacttccccgctggcccctttgttcccctcccggggccctgccggcggcggggcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatagcatggatttggatatgaaacaagattgtagtcaactggtagaaagaataaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 139964 - DNA, 9080 bp, Homo sapiens
  Payload ID: 7450
  Gene Symbol: HECTD1
  Gene Name: HECT domain containing E3 ubiquitin protein ligase 1
  Uniprot ID: Q9ULT8
  ENST ID: ENST00000553700
  CDS Start-End: 436-8268
ggatttgctccgcctccgccgggctcggctgccctcggcagcttccccgcctggctctccctcgaccctcctcccctccccctcccggttcgcgatggactgggcctccccgccgcgccgccgccgccgtcgcccgcagcaccgcgcgggcctctgagttgcagggcctgaggagccgcgtgctggggactggacgtccgctggctgctgccgcacgcgagaacctctcgcttccctgtcaccaggtcctcgcggaggaaggggagggacgaggcgcggcttttcctgtgccgcctgcccggttcgacctgcgcggcctgcggcttcttgggaactctagggccgcggccgggcctggctctgccggcggcctgttgggagctggatcggagcggtttggaacgacaagcccgacaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatagcatggatttggatatgaaacaagattgtagtcaactggtagaaagaataaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 139965 - DNA, 775 bp, Homo sapiens
  Payload ID: 7450
  Gene Symbol: HECTD1
  Gene Name: HECT domain containing E3 ubiquitin protein ligase 1
  ENST ID: ENST00000555915
  CDS Start-End: 1-368
ggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgtttttatgaagaacagtttgtcagcatcttcatttatgcaggacaatgtaatttgacccagtctccatcgaaggcaagagattataagaaggaaggagataaaaatgatatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttg

SEQ ID NO: 139966 - DNA, 3748 bp, Homo sapiens
  Payload ID: 7450
  Gene Symbol: HECTD1
  Gene Name: HECT domain containing E3 ubiquitin protein ligase 1
  ENST ID: ENST00000554882
  CDS Start-End: 1-2930
ctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggagattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgtacagaa

SEQ ID NO: 139967 - DNA, 4395 bp, Homo sapiens
  Payload ID: 7450
  Gene Symbol: HECTD1
  Gene Name: HECT domain containing E3 ubiquitin protein ligase 1
  ENST ID: ENST00000553957
  CDS Start-End: 1-4395
gtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatagcatggatttggatatgaaacaagattgtagtcaactggtagaaagaataaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcctcagtttacttttccaccagatgaattcactagc

SEQ ID NO: 139968 - DNA, 3267 bp, Homo sapiens
  Payload ID: 7450
  Gene Symbol: HECTD1
  Gene Name: HECT domain containing E3 ubiquitin protein ligase 1
  ENST ID: ENST00000556224
  CDS Start-End: 490-3267
ggcttcttgggaactctagggccgcggccgggcctggctctgccggcggcctgttgggagctggatcggagcggtttggaacgacaagcccgagtaagagcctgcgggaaggggaggcgggagcgcctcggaccgtcggaagggccctgcgtgggggcgcggatcccggacgcccggcgagtggcggaaagcgagaccccggcgccgagtgaggtcggccaggctgctgccgacttccccgctggcccctttgttcccctcccggggccctgccggcggcggggcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaat

SEQ ID NO: 139969 - DNA, 554 bp, Homo sapiens
  Payload ID: 7450
  Gene Symbol: HECTD1
  Gene Name: HECT domain containing E3 ubiquitin protein ligase 1
  ENST ID: ENST00000557369
  CDS Start-End: 1-554
atccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatgcttctcctcttatgggtgctcagagtttccctaatttgaccacacctggtactacatcaacagtgactatgtcaacatccagtgttactagcagcagcaatgtagctacagcaacaacagttttatcagttggtcaatctt

SEQ ID NO: 139970 - DNA, 819 bp, Homo sapiens
  Payload ID: 7450
  Gene Symbol: HECTD1
  Gene Name: HECT domain containing E3 ubiquitin protein ligase 1
  ENST ID: ENST00000554471
  CDS Start-End: 1-637
agattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggaggtcagaaaatatttttttaaatataaaaagaaagttgtgagataaccatataggcagtttctagttttcggacagtactcttagaaatccagataacaaagtggcaccccttcgatattctcccctatccctgtgcataattatgtaattatcagcttggttcttggtgaaacctgaataaatgcttgttgaatgggtaaaa

SEQ ID NO: 139971 - DNA, 8980 bp, Homo sapiens
  Payload ID: 7450
  Gene Symbol: HECTD1
  Gene Name: HECT domain containing E3 ubiquitin protein ligase 1
  ENST ID: ENST00000611816
  CDS Start-End: 324-8168
cggacgcccggcgagtggcggaaagcgagaccccggcgccgagtgaggtcggccaggctgctgccgacttccccgctggcccctttgttcccctcccggggccctgccggcggcggggcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatgtaagtttatcaagtagtaaagaaaaaaatacagttttaaaaattatttcaactggtagaaagaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 139972 - DNA, 4802 bp, Homo sapiens
  Payload ID: 7451
  Gene Symbol: HECTD2
  Gene Name: HECT domain containing E3 ubiquitin protein ligase 2
  Uniprot ID: Q5U5R9
  ENST ID: ENST00000298068
  CDS Start-End: 95-2425
gagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcgcccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatacttttacagaatcctcagtttaataacacatctacgtatgtcatctatgctcacttgctacgacagatagctaccttagtggaagctgaccatcatttcctagttcactggtttaaaaaattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggttttccttctgtcagtacccattcgttatttctgtagctgcaaaaaaaatcattattcagagagactcagagcaacagatgataaacatcgcaaggcaaagtctggtggataaagtatctcgaagacagagacctgatatgaatatattatttctaaatatgaaagtaagacggacacatctggttagcgattcacttgatgagctaacccggaaaagagccgatttgaaaaagaagttaaaagttacatttgtaggggaagctggtttggatatgggtggtttgactaaagaatggttccttcttctaattcgccaaatttttcatccagattatggcatgtttacatatcacaaggattcacactgccattggtttagcagctttaaatgtgataactattctgaattccgattggttggaattcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgagttggcccatggattaagtgaactcttatcacatgaaggcaatgttgaagaagatttctattcaacatttcaggtttttcaagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtcagtc

SEQ ID NO: 139973 - DNA, 4354 bp, Homo sapiens
  Payload ID: 7451
  Gene Symbol: HECTD2
  Gene Name: HECT domain containing E3 ubiquitin protein ligase 2
  ENST ID: ENST00000371667
  CDS Start-End: 629-1909
gacctcagctggaaatgtgcatgtcaggagactaacatctttcacatgtccccaaatgaccatgaaaacacaagtattgatttggggattaacaattaaattttaccaagtaggcaaatttggaaatatagaatctgtgaataatgaagactgaatattgaaagtctttaaaatgtttgttactaactttatagtaattttggtgtttatttctcatttaacgaagacagtattcaaggtaagattttgtatcttttcaaatgtttggcaatttaagaaatagaatttgggggaatagtctaaaattttgtggcttaggatgtagtttaatatctaacagataattttggaaatagaaaatgtgaattttgattgcaattattttgaaatctttaccagattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggttttccttctgtcagtacccattcgttatttctgtagctgcaaaaaaaatcattattcagagagactcagagcaacagatgataaacatcgcaaggcaaagtctggtggataaagtatctcgaagacagagacctgatatgaatatattatttctaaatatgaaagtaagacggacacatctggttagcgattcacttgatgagctaacccggaaaagagccgatttgaaaaagaagttaaaagttacatttgtaggggaagctggtttggatatgggtggtttgactaaagaatggttccttcttctaattcgccaaatttttcatccagattatggcatgtttacatatcacaaggattcacactgccattggtttagcagctttaaatgtgataactattctgaattccgattggttggaattcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgagttggcccatggattaagtgaactcttatcacatgaaggcaatgttgaagaagatttctattcaacatttcaggtttttcaagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtcagtcaggcttcagtttattttttgaacacttgggcaattaattaaagccatatgtttaaaatattttataaa

SEQ ID NO: 139974 - DNA, 2175 bp, Homo sapiens
  Payload ID: 7451
  Gene Symbol: HECTD2
  Gene Name: HECT domain containing E3 ubiquitin protein ligase 2
  Uniprot ID: Q5U5R9
  ENST ID: ENST00000371681
  CDS Start-End: 96-719
agagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcgcccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactgtaagtattatgacatgcaagtaatattattctgtgtctcttctgtatatcaaaagcagccatacaaatattgtaaaaatcaccttataattaccttagaaactctgatacaattttatagtaaatgtagctggaattctcataaagttagattattttattcttttattttttaattatgaattaagcagcaaatacttttatatccaatccttttttagaaagacttgctaaaatcatgctttacttactcagcaaaaggaggtaagttatttaattatattggaattacactgaatctgtagatcagtggttcttaaacattagcctgtatcagaatcacaagaagggcttgttaaaatacagaatttcagattcagtaggtcttgggtgaagcccaagaattttcatttgtaacaagttcccaggatatgttgatttatgagttcatttatgatgtgacacatactataaaaattatgtcaccattcaaaaaatccagatgcatatttgaaggactaagtgggaatgataaagacagaatgtaaacaaagtctccagaagtttagctatgaagtgaaagacatgttaagaatgaccacattttgagaaccatactgctatagatcaatttgtgaaaaattgacatcttttcaatccataagcatactgtatccttttaggtacctaggtcttctttaatttctcttggtaatgttttgtagttttctggatagaggtgttacacatttctcattacatgtatttctaggtacttcattttttttatcctattataattttattttccaattgtgactaatatatggaaatactttcatatatttatctttatctaaatacagttgacccttgaacaatgcgagggttaggggcgctaaccccctatgcagtaaaaaaaaaaatctgtgtataacttttgactccccagaagcttaactactaataacctattgttgaccagaagtcttactgataacataaacagtcaattaacgtatattttatgttatatgtattctatactatattgttacaataaagtaagctaaggaaaaggcaatgttattaagaaaaaataaggaagataaaatatatttactatatattaagtggaagtggactatcataaaggtcttcatccttattgagtaggctgaggaagaggaggggttggtcttgctgtctcaggtggcagaggtgaaagaaaataatgtatataagcagacttgcacaattcaagcctgtattcaagagtcaactgtactttgctatattcatccattaattctaatagtacatcagtaaattaacttggattttctgtgtacacaatcttgtcatttgtgaaaaaggagagttttatctccttctaatcctgtatcttatatggatatatgtatgtgtttgcattgactgggacctctttcacaattgtgaataaaagaagtaatagcag

SEQ ID NO: 139975 - DNA, 4939 bp, Homo sapiens
  Payload ID: 7451
  Gene Symbol: HECTD2
  Gene Name: HECT domain containing E3 ubiquitin protein ligase 2
  ENST ID: ENST00000446394
  CDS Start-End: 155-2497
ggcgcgggcgcgggcgggggcggagtggcggcggcagcggcggctagaagcggcagcccagagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcgcccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatacttttacagaatcctcagtttaataacacatctacgtatgtcatctatgctcacttgctacgacagatagctaccttagtggaagctgaccatcatttcctagttcactggtttaaaaaacagtattcaagattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggttttccttctgtcagtacccattcgttatttctgtagctgcaaaaaaaatcattattcagagagactcagagcaacagatgataaacatcgcaaggcaaagtctggtggataaagtatctcgaagacagagacctgatatgaatatattatttctaaatatgaaagtaagacggacacatctggttagcgattcacttgatgagctaacccggaaaagagccgatttgaaaaagaagttaaaagttacatttgtaggggaagctggtttggatatgggtggtttgactaaagaatggttccttcttctaattcgccaaatttttcatccagattatggcatgtttacatatcacaaggattcacactgccattggtttagcagctttaaatgtgataactattctgaattccgattggttggaattcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgagttggcccatggattaagtgaactcttatcacatgaaggcaatgttgaagaagatttctattcaacatttcaggtttttcaagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtcagtcaggcttcagtttattttttgaacacttgggcaattaattaaagccatatgtttaaaatattttat

SEQ ID NO: 139976 - DNA, 395 bp, Homo sapiens
  Payload ID: 7451
  Gene Symbol: HECTD2
  Gene Name: HECT domain containing E3 ubiquitin protein ligase 2
  ENST ID: ENST00000631422
  CDS Start-End: 326-395
aaaggaaaggaaattgtctaggtgtcctggtggtggaggtggggggtattttaatttcataattaaaagctctcttcttcggctttcaagtttttactcctatttgtaatgatttgattgaggactgtgcagcagagtttggggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaa

SEQ ID NO: 139977 - DNA, 2530 bp, Homo sapiens
  Payload ID: 7452
  Gene Symbol: HECTD3
  Gene Name: HECT domain containing E3 ubiquitin protein ligase 3
  Uniprot ID: Q5T447
  ENST ID: ENST00000372168
  CDS Start-End: 163-1578
ctgtcctcctgcagaggtggctgtggtcctggacctatgggcccttcccttcccccaacattgagccttgtgtgtctgcatggaggaggttcccaaggtctcatagtataagctgttcaagggtcagagaagcccccaggtcctgccttttcctgtccctttatgttggggagttgggggtgttacaggtatgctaaactctttagctgcagtctatctacccatgccagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacattctgctcttttcccctctccctccataccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattcattccttca

SEQ ID NO: 139978 - DNA, 3610 bp, Homo sapiens
  Payload ID: 7452
  Gene Symbol: HECTD3
  Gene Name: HECT domain containing E3 ubiquitin protein ligase 3
  Uniprot ID: Q5T447
  ENST ID: ENST00000372172
  CDS Start-End: 73-2658
gctctgtccgcggtcgcgccagctgttccccgggcagggtcgcctctaggtgctcacctccgccacttcgccatggcgggtcctggcccgggcgcggtgctggagtccccccggcagctgctgggccgcgtgcgcttcttggcagaggcagcgcggagcctccgcgccgggcggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacattctgctcttttcccctctccctccataccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattcattccttca

SEQ ID NO: 139979 - DNA, 15759 bp, Homo sapiens
  Payload ID: 7453
  Gene Symbol: HECTD4
  Gene Name: HECT domain containing E3 ubiquitin protein ligase 4
  ENST ID: ENST00000377560
  CDS Start-End: 312-13562
atgccgggagccccgcccccaacatggcgtctcactgacagttggttgccgagcggcagaggcggatcctgctcctgagggcggcggcggcggcggcggcggcggcggcggcagggccggggtctcccgggccggggtcgggggtatggcgactcggaccgcctagggcggagttgcacgggcgaggcagcaagtggggcgccgctggcgggcgcggcggccgctgccatggactggtgatcgcggcggctcctgctccgtttcccccggccgggcgtctgctcctcagcgccaagccttcagccggggccatgggctcgtcggcggccgcggcggcggcggcggcggcggccgctgactcggcgcagtggctctcggtgaaggaagagaccatcttcctgcacgacgggctgatccgggtcaccgacctggccgagctgcccagcgagatcctcggggccccagaggccgcggacaccgacctggagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtgatgaggaaactttggccctgctcaaacgccagggcttgttgcagcaacctgagcaagcgcccttcacatcgaggatggggctcctgctggtcttcccccttattcagtcccagagtagaacagacccctctctctgtaacataactgctgaggtgctattgaactgccttcgtgactgccagcctttgagcttgaccaaggagcctgctgactgtctcaatggaattgaaactttgctgtgctcttggctagaggagacttctgacacaggccgacacatcccacataagcaaaaagaaaatgctgctgctgccctggtggctttggcttgtgccaggggatcattgaaaactttcgtccacacagtccatctattacagaaacagacggatctagggtccctgcctgtagctgatgtgctatataggctgttgcttttggaaggggggcctggatctccctcctgtttgcttgggggcaaacacatagtatcatggggttatgaagacatgttgcctgcgccggatagcaacactggctccagttctgaaaataaagatgctgacttgggacgctgtctcacggcagatggtctttacctgtatactactaactcagttggaagaggagtaagcaaattgggatctggattacatggtactctcagaggttttgtgtactgccggaacgaggagttggaaccaggatgggtggcttttggcagcggcagtcttctccaccggcctgtctctttcgataataaacctcactcccttttccaggtcattgaccagaacacccttcaggtgtgccaggtggtgccaatgccagccaatcacctccccattggcagcaccatgagcactgtgcacctgtcttcagatggcacttacttctattggatctggtctcctgccagcctgaatgagaaaacaccgaagggacattctgtcttcatggacatttttgaacttgtggttgaaaatggtgtatttgtagccaacccacttcaggaacgtacaattctaatgagaaaagagggcgaatctgccaaaagcattaatgagatgcttctaagtagactttctcggtatagagcctccccgtcagcaacgcttgctgccctgactggttccaccatctccaacacactgaaagaggatcaagcagcaaatactagctgtgggctgcctctaaaaatgctgcggaagacacccatatatacctgtggcacctacttggtgatgctggtgcctcctccagggggatcaggcagctctgccacccgatctctttttggtggaacaagtggtttgtcatctttaaaaatcctagcctccagcttggtgtataatatttcggatggtcagtttacaagtcgtgcagatctcatagatgctgctggaagctcactggggcgtggtgctctcgtaccaggattgggagcgtgttatgacacagtgaacaacatgctatggacatgctcaaatgactatatcgatcagtggtgtaaccctgggaatcaagccttccattatgtctgccagagacttggagtcagtcacattatcactgagcccaaagaagaggctataaccacgaatgaggttataaaccaattattgcaccacgttggtgcgatgtgcatacaccaactcaatcttcttgccaccaaccccaatcttccaatcacaagtgtcttgggcaagcagcatccaattgaagcacatcatcttagcagtatttgtgacattatggagaaggccatggttaatggagatacctgtattatacgctgcattctcgttgtctttcaggtggtatttaaatttttcttcagcccacaaactgaaaggaatcgagacatcattcgacggtcgggattgcttctttggcagttgttgatggctccaaaagatcaaatttgccctgaaattcagaaggaagtctgccttgccatcagctctggtttaaatatcttgtacccaggtgaaactgaaatcaataacttacttaaactggtcttaacagaaggagagagaaacagtggactctcccagctacgggatgtgatcctaaccaacctggctgaacagctccaaaacaaccgatttggcagtgatgaggatgatcattacagactaaatgatgaacttttacactacattctgaagattgttgtacgagaatcctgtatcttaatcaccaagtgccaaactgtctctaaagatgattttcaaaagctcctttcaactgtgcctgctgcatcctcctgcctgcgctatctgatggcagttcagaatcaccttctcagtaacactattttgattaaacctgatgagaatgatgacagtgacagctccttgcagggagagacattgaaggagctaaaagtcagtattttggctcttgccacccaaatcctgactggatgtgatgaagtgttggaaatgctacagcaggtcacaactgccctcataaatagtgacatagcagaccgtgagcagaggttaaaaggcttggaacaagttactaaggctactatgcttggtcaccttcttccagtgttactgacctccttgatgcatccaaatttacagactctgatcatggcggatgccctgatgcctcagctagtgcagctggtactctataccagccagacggcgttgctgcttaaaacccagtgtccggtttttgctgaggtgggctgttccccgtgtggtgcaccagaccagaagtgcaggctgttccctgatgagagaatgttagaagagaaggaagagccaggatttctcactggtttaaagattcctgccccatgggctgctggaaagactgtggaaacagtccaccccgtcagagacaactataaatttaaagaaacggtccatatcccaggagctcgctgcctgtaccttagatttgatagcagatgctcttcgcaatatgactatgacaaattggtgatatatgcggggcctaacacaaacagtaggaaggttgctgaatatggaggcaacacactgggatatggcagccgtagtgtcttaggaactggttggccgaaagacttggtgaaggtggaaggagatacagtcaccttctcctttgaaatgagaagtggccgtgaacacaacactcctgataaagccatgtggggctttgcttgcacagttcgcgctcaggagtcttcggaggatgtctcaggaggcttgccctttctggtagacctggctttaggtctgtctgtgttagcttgttccatgttaagaatcctgtacaatggaccagaaattaccaaagaagaagaagcctgtcaggagctattgcggtccaaacttttacaaaggtgccagtggcaggtggaggccaatggcgtgatctcccctgcccttactccgagcccctctccactgcctctgaccatagaggaagacagagaattcacctacccctctgatgtcctcgtgcctcctgttggaaactactttgatctgcctcggatcagactgcctccaggaatcatgataaagctcagggaaatttctgggcgtgctagacctcaatttagaccaagtataaaagaagtgattcagccagacgtgatggaggaaatggtggtatcttgtgttattaagcacttgaacttggttgatgcactgcagtctctaataaatttccaatatcaagaagaacatgctgaagaatatgatttattatgtaaaattatgggagagacctttaagaaactcaatgccatggagagacagctgcagagtgttgcagaactggaacaaaaatggcaaagtgaagttgatgatgccatgcaggggaaactggagaacaacatgcctttcttttatgattaccattttaatgagaacaaaatgaaagaactagaacttttatgttcaatgaaggaagtctcctttgatgggaatgatcttgaaaacatggtcctatcactgagggagaagttcctacaagaagtgaattctcttattcagaaaccctcacacccactggctaaaacaaagacgttagtgaagagtttaatgaaccgagccgagctgttgctgcatgtcaccatcgcagcccagtcgggcctcacgagaagcatctctgggacccctgctgaaacaccagcttgtaaatcagcttctgaaacaaaagtgatatctcacgctgtcaggcagcctgtttttcttcgcagcatgtcagctccttctgacctggaaatgattggtaatgaagatttggaatttactagagcaaatcagaggcgtcgccacgtgaccagccaccgcagcagctcctttacactcctgcagtcgctggccattgaggacagcagggacaagcccacctacagtgtcctgctagggcagctgtttgctttcatcggcaccaaccctgaccaagctgtgtccagcagcagtttccttttggctgcacagacaaggtggcggcggggaaacactcgcaagcaggcactggtgcacatgcgggaattgctgacagctgccgtacgagtcgggggagtgacgcatcttgtgggtccagtgacgatggtccttcagggaggacccagaattgaagaactcacatgtggtgggatggtcgagcaggtccaggaagcctttggcgagaccatgacctctgttgtgtctctgtgtgctcgttaccctatcgcttgcgcaaatagcattggactcttatgtaccataccttacaccaggagcgaagagaagtgcctggtacgcagtggccttgtgcagctcatggatcgactgtgtagcttgagcaatcagaccgagtccagctccagtgagaaacagaccaagaagcagaaggtggccaccatggcctgggctgccttccaggtgcttgccaaccgctgtgttgagtgggaaaaagaggaaggtggctccacagaggctgtgcactcaggtctggcccggcaggtgtccagccttctcactaaccatcttgcccgagccacagagtgctgtggcaaccaggctgctgggaatgacgcgctccaggatgtccttagtcttctcaatgatctctcaaggagccacataggtaaagccatcctgagccagccagcttgtgtgtccaaactcctctccctgctgcttgaccaacgcccgtctccaaagctagtccttattattctccagctgtgccgggcggcgctgcccctgatgagcgtagaagactgtggaaacgtggagctcccaccctggagctactctgtcccctccttaaacagtgagcaggaggatcccagcgacccagcttccaagatcgcctccctgctcttagcaaagctggcagattatgtggttccaggatgtcagacagttctttctccaaccgcttctgaacctgacaccacattgacaaaaaccagtcccaagaattccttgaaaggagataaagatcctggagaagagagtgaggctgtggatggcaagctctcgatatttatccacaagcgggaagaccagtcatcccatgaagtcctccagccattgctaagtagttcagaaggacggcccttccgacttggtactggcgccaacatggagaaagttgtgaagatggatcgagacatgaccaagggtggctgttgcgaagtgattacagaagaggctgcagccgccctgcggaaagccaccaagtgggcacagtcaggcctcatcgtcagcattgggccacctgtagagtctatcaacccagagactgtgagtggactatccacaggcgacaaaaagaaaactgcccaaacttccatttgccgagagaggaactcggagcttgcaaggactgatcctgtgcgtcccttcatcagtgggcatgtggcaaacagcatggctgcagaagtgatcgccttgctacatagcttgctcatggcacctgaatcaaatgctgctcaaatatggaccacaacagcagagaaggttctgtctagagcactgatgtacattccacaattggggaaatacgcagaaagcattctggaaaatggcagcagcagtggcaggaaacttgccaaacttcagagaattgcacgccaggccgttgccgcactgtgtgcacttggaggcttcaaagagacaatcaagataggatccgaggttcaggttttaggtagaggaatttcaggaagcattggagtagtggcttctatcaatgaacaggaaggtatagctacagtcagattcccacccatagactgtagaaagacttcgcaagcgtcagacacattgactattccattgtctagactttgtgttccaagatcagaggcattgcctcttcataaactgtccattactgagaaggtagtacaggcagtccagtccatgttgcttcctcaggagggaagtctctctattcacacctcacttcctgcaacaggagatgggtcagctcctgtgatggcagtcgttcggctccttgctgaaataaggacaagagcatgcctggtcatggcccagcttttagaagacagcttattttgtgaagaattcatacaacaatgtccagcagctgttgaagttcttaacctagtagcccaggaatgtagtgctggagagcgacttgcagttgtggaggtacagtgtgaacggctgaggatgctctaccgggactgtgctcggcccccaccacctcctttgcaggctgaccgaagacagcccaaagagattacttggagcccctcgcgagtgtttccgcctgttcgagcctgcatgttctcatctcaccttacctcagtcaccttcctggctgaccccagcgctgggggaggcctgccccggggcacttttatctatgccacttcaccactgccagttcaggccccgtctttttactgggaaattgaaatcgtttcctatggagacaccgatgatgacaccggacccatagtttcctttggcttcactacagaagcagagaagcgagatggggcttggactaatccagtgggcacttgtcttttccataacaacggccgagccgtgcactataatggctccagtttgttacagtggaagagcgttcgcttagacgtgactctctcccccggtgacgtggcaggaattggctgggagagaactgaggggactccacctcctccgggacagccagccaagggccgggtgtacttcacatactgcgggcagcgcctctcaccatatcttgaagacgtctctggtggcatgtggccagtggttcacattcagaaaaagaacaccaaaacccgagctaactttggctcccggccgtttgcctacgcggaagggcaggcccaccgcaatgctgctgacctgtgcactgacctagcagaagagatcagcgctaactttgaggccctgcctttcgccatggcatctgacagtgacaatgatgctggcaccagtattgcatcagacccaggcactcatgggccaccatgccggattgctgccgtggccaccgctcagcaacaatatgatagtgacacctcctgtcattataaagtcgagctcagctatgagaatttcatcacctctggcccagaccctcacccgcctcccattgcagatgatgaaagcgatgatgatgacgatgatgacatccctcaggaggaccactacgccctgctggtgaaagcatgggagaccaaggtttttcctaccatccgaagacgcttccgcaatgaagcagagcggaaatcgggcctggaccagataaagggggccttacaactaggtatggtggatattgcccgacagacggttgaatttctctacgaagagaatggtggcatcccaagagacctttatcttcccaccattgaagacattaaagacgaagcaaacaagttcacaattgataaagttcgaaaaggtctcacagtagtaacccgctctccagacagcaataatgtagccagcagtgctgttggaactgctctgccaaaatttgccatccgagggatgctgaaaacctttgggcttcatggagtcgtcttagatgttgattcagtgaatgaactggtgcaggtagaaacgtacctccgcagtgaaggtgtgctggtgcgatactggtatcctattgacatgttggaaaggcccccagcaggctaccgaaggactgccaccaatgggctggtcacactggacaataccaaccttcaaattcacagggagctgctgcgctgcgaggctgcgctggccaggctgtactgccgcatggccctgctcaatatcttcgccccgaagttgcctcacttgttcactcgcctcttccacatccctgccatccgggacattaccctggagcacctgcaactgctgtccaatcagctcctcgcacctcctctcccagacggcaccatcagctccagctcgatcctcctggcgcagtctttacagcattgcatccattcccagaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatgg

SEQ ID NO: 139980 - DNA, 587 bp, Homo sapiens
  Payload ID: 7453
  Gene Symbol: HECTD4
  Gene Name: HECT domain containing E3 ubiquitin protein ligase 4
  ENST ID: ENST00000550724
  CDS Start-End: 1-330
gcggccgctgactcggcgcagtggctctcggtgaaggaagagaccatcttcctgcacgacgggctgatccgggtcaccgacctggccgagctgcccagcgagatcctcggggccccagaggccgcggacaccgacctggagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtggtatttaaatttttcttcagcccacaaactgaaaggaatcgagacatcattcgacggtcgggattgcttctttggcagttgttgatggctccaaaagatcaaatttgccctgaaattcagaaggaagtctgccttgccatcagctctggtttaaatatcttgtacccaggtgaaactgaaatcaataacttacttaaactggtcttaacagaaggagagagaaacagtggactctcccagctacgggatgtgatcctaaccaacc

SEQ ID NO: 139981 - DNA, 15450 bp, Homo sapiens
  Payload ID: 7453
  Gene Symbol: HECTD4
  Gene Name: HECT domain containing E3 ubiquitin protein ligase 4
  ENST ID: ENST00000550722
  CDS Start-End: 397-13251
gcggccgctgactcggcgcagtggctctcggtgaaggaagagaccatcttcctgcacgacgggctgatccgggtcaccgacctggccgagctgcccagcgagatcctcggggccccagaggccgcggacaccgacctggagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtgatgaggaaactttggccctgctcaaacgccagggcttgttgcagcaacctgagcaagcgcccttcacatcgaggatggggctcctgctggtcttcccccttattcagtcccagagtagaacagacccctctctctgtaacataactgctgaggtgctattgaactgccttcgtgactgccagcctttgagcttgaccaaggagcctgctgactgtctcaatggaattgaaactttgctgtgctcttggctagaggagacttctgacacaggccgacacatcccacataagcaaaaagaaaatgctgctgctgccctggtggctttggcttgtgccaggggatcattgaaaactttcgtccacacagtccatctattacagaaacagacggatctagggtccctgcctgtagctgatgtgctatataggctgttgcttttggaaggggggcctggatctccctcctgtttgcttgggggcaaacacatagtatcatggggttatgaagacatgttgcctgcgccggatagcaacactggctccagttctgaaaataaagatgctgacttgggacgctgtctcacggcagatggtctttacctgtatactactaactcagttggaagaggagtaagcaaattgggatctggattacatggtactctcagaggttttgtgtactgccggaacgaggagttggaaccaggatgggtggcttttggcagcggcagtcttctccaccggcctgtctctttcgataataaacctcactcccttttccaggtcattgaccagaacacccttcaggtgtgccaggtggtgccaatgccagccaatcacctccccattggcagcaccatgagcactgtgcacctgtcttcagatggcacttacttctattggatctggtctcctgccagcctgaatgagaaaacaccgaagggacattctgtcttcatggacatttttgaacttgtggttgaaaatggtgtatttgtagccaacccacttcaggaacgtacaattctaatgagaaaagagggcgaatctgccaaaagcattaatgagatgcttctaagtagactttctcggtatagagcctccccgtcagcaacgcttgctgccctgactggttccaccatctccaacacactgaaagaggatcaagcagcaaatactagctgtgggctgcctctaaaaatgctgcggaagacacccatatatacctgtggcacctacttggtgatgctggtgcctcctccagggggatcaggcagctctgccacccgatctctttttggtggaacaagtggtttgtcatctttaaaaatcctagcctccagcttggtgtataatatttcggatggtcagtttacaagtcgtgcagatctcatagatgctgctggaagctcactggggcgtggtgctctcgtaccaggattgggagcgtgttatgacacagtgaacaacatgctatggacatgctcaaatgactatatcgatcagtggtgtaaccctgggaatcaagccttccattatgtctgccagagacttggagtcagtcacattatcactgagcccaaagaagaggctataaccacgaatgaggttataaaccaattattgcaccacgttggtgcgatgtgcatacaccaactcaatcttcttgccaccaaccccaatcttccaatcacaagtgtcttgggcaagcagcatccaattgaagcacatcatcttagcagtatttgtgacattatggagaaggccatggttaatggagatacctgtattatacgctgcattctcgttgtctttcaggtggtatttaaatttttcttcagcccacaaactgaaaggaatcgagacatcattcgacggtcgggattgcttctttggcagttgttgatggctccaaaagatcaaatttgccctgaaattcagaaggaagtctgccttgccatcagctctggtttaaatatcttgtacccaggtgaaactgaaatcaataacttacttaaactggtcttaacagaaggagagagaaacagtggactctcccagctacgggatgtgatcctaaccaacctggctgaacagctccaaaacaaccgatttggcagtgatgaggatgatcattacagactaaatgatgaacttttacactacattctgaagattgttgtacgagaatcctgtatcttaatcaccaagtgccaaactgtctctaaagatgattttcaaaagctcctttcaactgtgcctgctgcatcctcctgcctgcgctatctgatggcagttcagaatcaccttctcagtaacactattttgattaaacctgatgagaatgatgacagtgacagctccttgcagggagagacattgaaggtacaggagctaaaagtcagtattttggctcttgccacccaaatcctgactggatgtgatgaagtgttggaaatgctacagcaggtcacaactgccctcataaatagtgacatagcagaccgtgagcagaggttaaaaggcttggaacaagttactaaggctactatgcttggtcaccttcttccagtgttactgacctccttgatgcatccaaatttacagactctgatcatggcggatgccctgatgcctcagctagtgcagctggtactctataccagccagacggcgttgctgcttaaaacccagtgtccggtttttgctgaggtgggctgttccccgtgtggtgcaccagaccagaagtgcaggctgttccctgatgagagaatgttagaagagaaggaagagccaggatttctcactggtttaaagattcctgccccatgggctgctggaaagactgtggaaacagtccaccccgtcagagacaactataaatttaaagaaacggtccatatcccaggagctcgctgcctgtaccttagatttgatagcagatgctcttcgcaatatgactatgacaaattggtgatatatgcggggcctaacacaaacagtaggaaggttgctgaatatggaggcaacacactgggatatggcagccgtagtgtcttaggaactggttggccgaaagacttggtgaagtgcatttcccccccttccttaaattttaaggtggaaggagatacagtcaccttctcctttgaaatgagaagtggccgtgaacacaacactcctgataaagccatgtggggctttgcttgcacagttcgcgctcaggagtcttcggaggatgtctcaggaggcttgccctttctggtagacctggctttaggtctgtctgtgttagcttgttccatgttaagaatcctgtacaatggaccagaaattaccaaagaagaagaagcctgtcaggagctattgcggtccaaacttttacaaaggtgccagtggcaggtggaggccaatggcgtgatctcccctgcccttactccgagcccctctccactgcctctgaccatagaggaagacagagaattcacctacccctctgatgtcctcgtgcctcctgttggaaactactttgatctgcctcggatcagactgcctccaggaatcatgataaagctcagggaaatttctgggcgtgctagacctcaatttagaccaagtataaaagaagtgattcagccagacgtgatggaggaaatggtggtatcttgtgttattaagcacttgaacttggttgatgcactgcagtctctaataaatttccaatatcaagaagaacatgctgaagaatatgatttattatgtaaaattatgggagagacctttaagaaactcaatgccatggagagacagctgcagagtgttgcagaactggaacaaaaatggcaaagtgaagttgatgatgccatgcaggggaaactggagaacaacatgcctttcttttatgattaccattttaatgagaacaaaatgaaagaactagaacttttatgttcaatgaaggaagtctcctttgatgggaatgatcttgaaaacatggtcctatcactgagggagaagttcctacaagaagtgaattctcttattcagaaaccctcacacccactggctaaaacaaagacgttagtgaagagtttaatgaaccgagccgagctgttgctgcatgtcaccatcgcagcccagtcgggcctcacgagaagcatctctgggacccctgctgaaacaccagcttgtaaatcagcttctgaaacaaaagtgatatctcacgctgtcaggcagcctgtttttcttcgcagcatgtcagctccttctgacctggaaatgattggtaatgaagatttggaatttactagagcaaatcagaggcgtcgccacgtgaccagccaccgcagcagctcctttacactcctgcagtcgctggccattgaggacagcagggacaagcccacctacagtgtcctgctagggcagctgtttgctttcatcggcaccaaccctgaccaagctgtgtccagcagcagtttccttttggctgcacagacaaggtggcggcggggaaacactcgcaagcaggcactggtgcacatgcgggaattgctgacagctgccgtacgagtcgggggagtgacgcatcttgtgggtccagtgacgatggtccttcagggaggacccagaattgaagaactcacatgtggtgggatggtcgagcaggtccaggaagcctttggcgagaccatgacctctgttgtgtctctgtgtgctcgttaccctatcgcttgcgcaaatagcattggactcttatgtaccataccttacaccaggagcgaagagaagtgcctggtacgcagtggccttgtgcagctcatggatcgactgtgtagcttgagcaatcagaccgagtccagctccagtgagaaacagaccaagaagcagaaggtggccaccatggcctgggctgccttccaggtgcttgccaaccgctgtgttgagtgggaaaaagaggaaggtggctccacagaggctgtgcactcaggtctggcccggcaggtgtccagccttctcactaaccatcttgcccgagccacagagtgctgtggcaaccaggctgctgggaatgacgcgctccaggatgtccttagtcttctcaatgatctctcaaggagccacataggtaaagccatcctgagccagccagcttgtgtgtccaaactcctctccctgctgcttgaccaacgcccgtctccaaagctagtccttattattctccagctgtgccgggcggcgctgcccctgatgagcgtagaagactgtggaaacgtggagctcccaccctggagctactctgtcccctccttaaacagtgagcaggaggatcccagcgacccagcttccaagatcgcctccctgctcttagcaaagctggcagattatgtggttccaggatgtcagacagttctttctccaaccgcttctgaacctgacaccacattgacaaaaaccagtcccaagaattccttgaaaggagataaagatcctggagaagagagtgaggctgtggatggcaagctctcgatatttatccacaagcgggaagaccagtcatcccatgaagtcctccagccattgctaagtagttcagaaggacggcccttccgacttggtactggcgccaacatggagaaagttgtgaagatggatcgagacatgaccaagggtggctgttgcgaagtgattacagaagaggctgcagccgccctgcggaaagccaccaagtgggcacagtcaggcctcatcgtcagcattgggccacctgtagagtctatcaacccagagactgtgagtggactatccacaggcgacaaaaagaaaactgcccaaacttccatttgccgagagaggaactcggagcttgcaaggactgatcctgtgcgtcccttcatcagtgggcatgtggcaaacagcatggctgcagaagtgatcgccttgctacatagcttgctcatggcacctgaatcaaatgctgctcaaatatggaccacaacagcagagaaggttctgtctagagcactgatgtacattccacaattggggaaatacgcagaaagcattctggaaaatggcagcagcagtggcaggaaacttgccaaacttcagagaattgcacgccaggccgttgccgcactgtgtgcacttggaggcttcaaagagacaatcaagataggatccgaggttcaggttttaggtagaggaatttcaggaagcattggagtagtggcttctatcaatgaacaggaaggtatagctacagtcagattcccacccatagactgtagaaagacttcgcaagcgtcagacacattgactattccattgtctagactttgtgttccaagatcagaggcattgcctcttcataaactgtccattactgagaaggtagtacaggcagtccagtccatgttgcttcctcaggagggaagtctctctattcacacctcacttcctgcaacaggagatgggtcagctcctgtgatggcagtcgttcggctccttgctgaaataaggacaagagcatgcctggtcatggcccagcttttagaagacagcttattttgtgaagaattcatacaacaatgtccagcagctgttgaagttcttaacctagtagcccaggaatgtagtgctggagagcgacttgcagttgtggaggtacagtgtgaacggctgaggatgctctaccgggactgtgctcggcccccaccacctcctttgcaggctgaccgaagacagcccaaagagattacttggagcccctcgcgagtgtttccgcctgttcgagcctgcatgttctcatctcaccttacctcagtcaccttcctggctgaccccagcgctgggggaggcctgccccggggcacttttatctatgccacttcaccactgccagttcaggccccgtctttttactgggaaattgaaatcgtttcctatggagacaccgatgatgacaccggacccatagtttcctttggcttcactacagaagcagagaagcgagatggggcttggactaatccagtgggcacttgtcttttccataacaacggccgagccgtgcactataatggctccagtttgttacagtggaagagcgttcgcttagacgtgactctctcccccggtgacgtggcaggaattggctgggagagaactgaggggactccacctcctccgggacagccagccaagggccgggtgtacttcacatactgcgggcagcgcctctcaccatatcttgaagacgtctctggtggcatgtggccagtggttcacattcagaaaaagaacaccaaaacccgagctaactttggctcccggccgtttgcctacgcggaagggcaggcccaccgcaatgctgctgacctgtgcactgacctagcagaagagatcagcgctaactttgaggccctgcctttcgccatggcatctgacagtgacaatgatgctggcaccagtattgcatcagacccaggcactcatgggccaccatgccggattgctgccgtggccaccgctcagcaacaatatgatagtgacacctcctgtcattataaagtcgagctcagctatgagaatttcatcacctctggcccagaccctcacccgcctcccattgcagatgatgaaagcgatgatgatgacgatgatgacatccctcaggaggaccactacgccctgctggtgaaagcatgggagaccaaggtttttcctaccatccgaagacgcttccgcaatgaagcagagcggaaatcgggcctggaccagataaagggggccttacaactaggtatggtggatattgcccgacagacggttgaatttctctacgaagagaatggtggcatcccaagagacctttatcttcccaccattgaagacattaaagacgaagcaaacaagttcacaattgataaagttcgaaaaggtctcacagtagtaacccgctctccagacagcaataatgtagccagcagtgctgttggaactgctctgccaaaatttgccatccgagggatgctgaaaacctttgggcttcatggagtcgtcttagatgttgattcagtgaatgaactggtgcaggtagaaacgtacctccgcagtgaaggtgtgctggtgcgatactggtatcctattgacatgttggaaaggcccccagcaggctaccgaaggactgccaccaatgggctggtcacactggacaataccaaccttcaaattcacagggagctgctgcgctgcgaggctgcgctggccaggctgtactgccgcatggccctgctcaatatcttcgccccgaagttgcctcacttgttcactcgcctcttccacatccctgccatccgggacattaccctggagcacctgcaactgctgtccaatcagctcctcgcacctcctctcccagacggcaccatcagctccagctcgatcctcctggcgcagtctttacagcattgcatccattcccagaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtc

SEQ ID NO: 139982 - DNA, 1030 bp, Homo sapiens
  Payload ID: 7453
  Gene Symbol: HECTD4
  Gene Name: HECT domain containing E3 ubiquitin protein ligase 4
  ENST ID: ENST00000548588
  CDS Start-End: 1-787
caggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgatgatagggttgcctgtgttgcctgtgagtcaggcatctcagccacctggccgagatctcagcctgactgctcctgcgccctcagacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaaggtcagtgcctgcacctgccctggccctgcaggaagagagaggtgacctgcaagacaccagggccagaatccacgggcagcgtccttgggcagccccgccaggaagatgccaccccacctcaacctttcatgtagcaggcagggctcctctggagcaacaggcccacccaagggaagttactttaattataaaagtaacatgctctgaaaaataaaattatttttaaggttttcaaattaattagaaatcatatatgaaggtctgtttactatctggcctccacatccctacatcccagaagtgacattgttaacagatgagtctctctccttccagacttttctcttgacatataaacagacacatgtgtgcacaca

SEQ ID NO: 139983 - DNA, 9501 bp, Homo sapiens
  Payload ID: 7454
  Gene Symbol: HECW1
  Gene Name: HECT, C2 and WW domain containing E3 ubiquitin protein ligase 1
  Uniprot ID: Q76N89
  ENST ID: ENST00000395891
  CDS Start-End: 606-5426
ggggatgcaagcgggaggataaagcgatgaagtgtgctgcgttaccgcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaagatatcaatgctatgttcagcagaaacggatacagcaagagcagcatagttcaaaaattgagggaggcatcttctctcttttcctgggatttaaacgcgatttaggagggcagatgccctacccgaaaaggccaaccgttaaagaccccggcagtgttgtggtccaaggcgtctcaaagcaggtggccagatctgcgtttctcatcagcagactcactccggctgtggctattacggaattgatgcgcgtacacgtggtgggtcattatgctgctgcacctgtgtagtgtgaagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaagggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgatgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacatttttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtcatttgctatttttctaacgttgttatccatgttgcctgaaataggtcataaatgaaagtgtttttcttcactgggaaaaagaagagctcaagagaccccactatttaaatgtcatttaattgttttccatattaaaacaagggagaaatgtaagacgaagtgaatttcatatgaagccaatggctcattataccagtttgtgtctggacagtgtgttatttgtgttcctacactctaaagcattccggccaggagcggtggctcatgcctgtaatcccagcactttgggaggccgaggtggggagatcgcttgaggtcaggagttcaagacaagcctggccaacatggtgaaaccccatctctactaaaaatacaaaaattagccgggcgtgatggcacatgccggtagtcccagctacttgggaggctgaggaaggagaatcgctcaaacctgagaagcagaggttgcagtgagccaagactgtgccactgcactccagcctggatgatcaagggagacaccatctaaaaaaaaaataaataaaaataaaagcatttttttagtaggaattatctacaatgcccagcaccccttgcagcgatgtgtccgttgtcaatcaaggagtatacattatagaaatttagacttttattgtctaaaaagaatatttactgagacaggatggaatctgtaagttatatgatatagaatttgagggatatgtaaaattcagtacacgttcagcatctgaaaaataatggattccaatggagctattgttttatttatgaaatcagagcataaggactatgcaaatcattgaaccataaccttattctaactcttgcaacaacatctctaatataggggcatcttttatctttagaacttggtgttatatatatgtaaatactcattaattcaagcactctctttctagtactcacattatttgtcaggcattggaaaaggagaaagctgtttacaagatggaccagctcctggagagctttgcaatttatataaattactaattaatctattaattagattaattaatatctaatctacccatatacaaaaggaatgcagtatctcagaaattatatatagataggtaactttggcatacatgatttttcaactaccgtttccttatccaccagtactactgatgtcacagctatagatctatcccacaaagcataacaggaacattctttcacaaaagtgcaaaatttcatgaagaaatgctgatgtcacggtcacctgaaagaagatgaagcttgtaatattttattgcaaccttgcatagaatccttaaggaagaaaaacaaagagaagaggaacacagaaacaagttatggaaattcatgtttaccttatttataaggctgatttttaaattatatataatttttcattcaatatgtatatgaaatgaaatagctatagaactaaatttcacttaggtggaggtataaaccaccttaaattatatagttcggcagaaagacagatctatttgttaccacctgtaatttttttttaagcatgagttttctccatggaggcaaattgcaaaattaatcacttataaatttataagccacaatctccctaaaacaattgattttagtaagagtgtaacgcctttaatcaggggacaaacaagaacaataaataagagaagatttatgttacaactttgaaaaatgcttttaaaattctataaagtgttataataatttcatggatatcacaaatgttttattctacagtgtgaagatgataatcctaaaaatggaaattgattctgtgaggtcaggagaagtattctaaatctactgaactctttgtaatttcctatgtatataaatgagtggaggttgtgaagatgccgagagagtggtgaaaaaattaagaaaaagagacatatgatttgggggagcaggcgttaaacatgcaagatctaaattttcttttaatacatgaccatatgtccttgaacagtaagtatatttgtgtggcaagccaatggctgagttttccagggtagttttaatattacatccatcatattttcagtccatgtgtcaaaccatgtgtccaaaatttgggttcggaaatttctcagttgccacaaatattttcccagtcaagatgaaacactttcaaatgaaagtagttagaactttacataacaaatgtggtgctttattattattattattattatttttattattattattattacgtacttcagtgttcattattaaaactaccgcaatactatatcataaaaatctgggatggatgttccagccatcataaggtccaaaagaaaagagaaagtgttattttcctgttagtgacatgtagtccctttgttctagtaggaaaaaaggtgcctagaggtagtatatagagtaaatattgttcctttagcctacttcctgcagcttccaatttatccaaggaaatgtctacaacaattttgttcaaaagtctgttctagtcaatagcaggagaagtccacgttattgggctgattttgcttacatcagcaagagaaatgtcacgtgatactcaggccgcgctttctcttccatcacaccatcttcaaggaatgtcaataaactcactttggtatggca

SEQ ID NO: 139984 - DNA, 5169 bp, Homo sapiens
  Payload ID: 7454
  Gene Symbol: HECW1
  Gene Name: HECT, C2 and WW domain containing E3 ubiquitin protein ligase 1
  Uniprot ID: Q76N89
  ENST ID: ENST00000453890
  CDS Start-End: 325-5043
gcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaaggaattgatgcgcgtacacgtggtgggtcattatgctgctgcacctgtgtagtgtgaagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaagactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaagggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgatgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaac

SEQ ID NO: 139985 - DNA, 415 bp, Homo sapiens
  Payload ID: 7454
  Gene Symbol: HECW1
  Gene Name: HECT, C2 and WW domain containing E3 ubiquitin protein ligase 1
  ENST ID: ENST00000429529
  CDS Start-End: 1-415
acccccgaatccctcttcagaacggtcgtcttcccaatcatctaactcaccgacagcacctccagaggctccgaagttacagcgctggagaggctagagtgcaatggtgcgatcttggctcactgcaacctcctcctcccaggttcaagcaattctcctgcctcagcctctcaagtagctgggattacaggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttgg

SEQ ID NO: 139986 - DNA, 11809 bp, Homo sapiens
  Payload ID: 7455
  Gene Symbol: HECW2
  Gene Name: HECT, C2 and WW domain containing E3 ubiquitin protein ligase 2
  Uniprot ID: Q9P2P5
  ENST ID: ENST00000260983
  CDS Start-End: 184-4902
atttgagcatcagttgagggagaggacgcttcatttcctttttggttgggaatgtgccgtgaacatcctctgctggagcttggggcctggagcaaactggggctgcagatttagacgtagacgtttccgaggacgcgagactgcagagctttgtaggcagccaatcccagagaagcagacgggatggctagttcagcccgggagcacctgctttttgtgaggcgtcgaaatccccagatgcggtacacattgagcccagagaacctccagagccttgccgcccagagctccatgccagagaacatgaccctgcagcgggccaacagcgacaccgacctggtgacttctgagagccgctccagcttaactgccagcatgtacgagtacacgctggggcaagcccagaacctcattatcttctgggacattaaagaggaggtggaccccagtgattggattggactttatcatatagatgagaattctccagccaacttctgggattctaagaacaggggtgtgactggaacacaaaaagggcaaattgtatggagaattgagcctgggccctatttcatggaaccggagataaaaatctgttttaaatattaccacggcattagtggagccctgcgagccacgaccccctgcatcaccgtgaagaacccagctgtgatgatgggggcagaaggcatggagggaggtgcttcaggaaacctgcattctcgaaaacttgttagctttacattgtcagatcttagggcagttgggctaaagaaagggatgttcttcaatcctgacccttatcttaagatgtcaattcagccaggaaagaagagcagtttccccacctgtgcccaccacgggcaggagagacggtctactatcatcagtaacaccaccaatccaatttggcaccgagagaaatattccttttttgcacttcttactgatgtcttagaaattgaaattaaagacaaatttgccaagagccgtcccatcatcaagcgttttctggggaaactaaccattccagtccagaggctgctggagcgacaagccatcggtgatcaaatgctcagctacaaccttggcagaaggctcccagctgaccacgtgagtgggtacctccagtttaaagtggaggttacgtcttctgttcatgaagatgcctctccagaagctgttggcacaatacttggagtcaattctgtgaatggagacttaggtagcccttccgatgacgaggacatgccagggagccatcacgacagccaggtgtgctctaatgggccagtttctgaggacagtgctgccgatggaacccccaagcattcattcaggactagctccactctggaaatagacacagaggaattaacctctacgtcttcaaggacctcacctcccagaggacgtcaggattcactcaatgattacttagatgctatcgaacacaatggccactccaggccggggacagcgacctgctctgagaggtccatgggtgcctctccgaaactgaggagtagttttcccactgacacaagactcaatgccatgcttcatattgattcagatgaagaagatcacgagttccagcaagacctgggttacccatcttccttggaggaggagggaggcctgatcatgtttagcagggcatccagagctgatgatggaagcctgacatctcagacaaagctggaggacaaccctgttgagaatgaggaagcctccacacacgaagctgcttcctttgaggataagccagaaaatcttccagagcttgcagagagctccttacctgcaggcccagccccagaggaaggtgaaggcggcccagagcctcaacccagtgctgaccagggcagtgctgaactgtgtggctctcaagaggtagatcagcccacaagtggcgcagacacagggacttccgatgcatcaggaggaagccgaagagccgtcagtgagaccgagtctctcgatcagggctctgagccttcccaggtgtcctctgaaacagaacccagtgatcctgccaggacagagagtgtgagcgaagccagcaccaggcctgagggagagagtgacctggaatgcgctgacagctcctgcaatgagagtgtgaccacgcagctgtcctctgtggacacacggtgctcctctcttgagagcgcacggtttcctgaaaccccagccttttcttctcaggaggaggaagacggagcctgtgcagcagagcccaccagcagtggccctgccgaagggtcgcaggaatccgtgtgcactgctggttctttacctgtggtacaggtgcccagtggggaggatgaagggccaggggcagaatcggccactgtacctgaccaggaggagctgggggaggtctggcagcggagggggagcctggagggagctgcagctgctgccgagagcccaccgcaagaagaaggcagtgctggggaggcccaaggcacctgtgaaggggcaactgcccaggaggagggcgctactggaggttctcaagccaacggccaccagccactgcgatcactaccttcagtgcgccaggatgttagccggtaccagagggtggacgaggctctcccaccaaactgggaggcacgcattgacagccacggcaggatcttctacgtggatcacgtaaacagaaccacgacgtggcagcgaccgacagctcccccagccccgcaggtgctgcagagatctaactccatacagcaaatggagcagctgaaccggcgatatcagagtatccgcagaaccatgaccaatgagaggcctgaggaaaataccaatgctattgatggggcaggggaggaagctgactttcaccaagccagtgcagatttccgacgggagaacatcctgcctcactctacctccagatccaggatcacgttgctgttacagtctccccccgtgaagttcctcatcagcccagagttcttcaccgtgctgcattctaaccctagtgcctaccgcatgtttacaaacaacacgtgtttgaagcacatgatcaccaaagtccggagggacacccaccactttgaacgctaccagcataaccgcgaccttgtgggattcctcaacatgttcgcgaacaaacagctagagctgccgcggggatgggaaatgaaacatgatcaccagggcaaggcattctttgtggaccacaactcccgcaccaccactttcattgatccccggctcccacttcagagcagtagacccacaagtgcgctggttcatcggcaacacctgacaaggcaacgcagccacagtgcgggtgaggtaggagaagattctcgacatgcaggaccaccagttcttcccaggccatccagtacattcaatacagtcagtaggccacagtaccaggacatggttccagtggcttacaatgacaagattgttgcatttctacgtcaacccaatatctttgaaattctacaggagcgtcaacctgatcttaccaggaatcactcactcagggagaagatccaatttatccgaactgaagggactccaggattggtgcgcctttcaagcgatgcagaccttgttatgttgctgagcttatttgaagaagagataatgtcgtatgtgcctccacatgccttactccaccccagctactgtcagtccccacgtggctctcccgtgtcatctcctcagaactcgccaggtacccagcgtgccaatgcccgggctccagccccttacaagcgggatttcgaagccaaactgaggaacttttacaggaagttagagactaaaggatatggacaaggcccagggaagttaaagttaattatccgaagagatcacttactagaagatgcttttaatcagattatgggctactccagaaaagacctgcagagaaataagctatatgtcaccttcgttggggaggaagggctggattacagtgggccttctagagagtttttcttcctggtatccagagaactctttaacccatattatggcttatttgaatattcagccaatgacacatacacagtacaaataagtcctatgtctgcttttgtagacaatcaccatgaatggttccgattcagtggtaggatccttggtcttgcactaatacaccagtatttgttggatgccttcttcacacggcccttttataaggctcttctcagaattctatgtgacctgagtgacctagaataccttgatgaagagttccatcagagcctgcagtggatgaaagacaatgatatccatgacatcctagacctcacgttcactgtgaacgaagaagtatttgggcagataactgaacgagaattaaagccagggggtgccaatatcccagttacagagaagaacaagaaggagtacatcgagaggatggtgaagtggaggattgagaggggtgttgtacagcaaacagagagcttagtgcgtggcttctatgaggtggtggatgccaggctggtatctgtttttgatgcaagagaactggaattggtcatcgcaggcacagctgaaatagacctaagtgattggagaaacaacacagaatatagaggaggataccatgacaatcatattgtaattcggtggttctgggctgcagtggaaagattcaacaatgaacaacgactaaggttgttacagtttgttacaggcacatccagcattccctatgaaggatttgcttcactccgagggagtaacggcccaagaagattctgtgtggagaaatgggggaaaatcactgctcttcccagagcgcatacatgttttaaccgtctggatctgcctccctacccatccttttccatgctttatgaaaaactgttgacagcagttgaagaaaccagtacttttggacttgagtgacctggaagctgaatgcccatctctgtggacaggcaggttcagaagctgccttctagaagaatgattgaacattggaagtttcaagaggatgcttcctttaggataaagctatgtgctgttgttttccaggaacaagtgctctgtcacatttggggactggagatgagtcctcttggaaggatttgggtgagcttgatgcccagggaacaacccaaccgtctttcaatcaacagttcttgactgccaaactttttccatttgttatgttccaagacaaagatgaacccatacatgatcagctccacggtaatttttagggactcaggagaatcttgaaacttacccttgaacgtggttcaagccaaactggcagcatttggcccaatctccaaattagagcaagttaaataatataataaaagtaaatatatttcctgaaagtacattcatttaagccctaagttataacagaatattcatttcttgcttatgagtgcctgcatggtgtgcaccataggtttccgctttcatgggacatgagtgaaaatgaaaccaagtcaatatgaggtacctttacagatttgcaataagatggtctgtgacaatgtatatgcaagtggtatgtgtgtaattatggctaaagacaaaccattattcagtgaattactaatgacagattttatgctttataatgcatgaaaacaattttaaaataactagcaattaatcacagcatatcaggaaaaagtacacagtgagttctgtttattttttgtaggttcattatgtttatgttctttaagatgtatataagaacctacctatcatgctgtatgtatcactcattccattttcatgttccatgcatactcgggcatcatgctaatatgtatccttttaagcactctcaaggaaacaaaagggccttttatttttataaaggtaaaaaaaattccccaaatattttgcactgaatgtaccaaaggtgaagggacattacaatatgactaacagcaactccatcacttgagaagtataatagaaaatagcttctaaatcaaacttccttcacagtgccgtgtctaccactacaaggactgtgcatctaagtaataattttttaagattcactatatgtgatagtatgatatgcatttatttaaaatgcattagactctcttccatccatcaaatactttacaggatggcatttaatacagatatttcgtatttcccccactgctttttatttgtacagcatcattaaacactaagctcagttaaggagccatcagcaacactgaagagatcagtagtaagaattccattttccctcatcagtgaagacaccacaaattgaaactcagaactatatttctaagcctgcattttcactgatgcataattttcttattaatattaagagacagtttttctatggcatctccaaaactgcatgacatcactagtcttacttctgcttaattttatgagaaggtattcttcattttaattgcttttgggattactccacatctttgtttatttcttgactaatcagattttcaatagagtgaagttaaattgggggtcataaaagcattggattgacatatggtttgccagcctatgggtttacaggcattgcccaaacatttctttgagatctatatttataagcagccatggaattcctattatgggatgttggcaatcttacattttatagaggtcatatgcatagttttcataggtgttttgtaagaactgattgctctcctgtgagttaagctatgtttactactgggaccctcaagaggaataccacttatgttacactcctgcactaaaggcacgtactgcagtgtgaagaaatgttctgaaaaagggttatagaaatctggaaataagaaaggaagagctctctgtattctataattggaagagaaaaaaagaaaaacttttaactggaaatgttagtttgtacttattgatcatgaatacaagtatatatttaattttgcaaacttttcacttgtttgtattcttttcattataaggaaaagtagtataacacacttttttttaagtcacatatttgatggtatacaagatgtttcagggctggcattctccaagcagcagataaaggttgcatttctttcaaaaatacattcaaagaccatgttatccttcattttggtttgagacatttagttatggtatttcatattattaggtaaaagatatttgaaataaaatgtatctctttaattatttctaacaaatatatttctttattaaggcatccaactttttcccaaataacagtacactttaatgtatgtagacattcttaattagtataatcatctagttgatactgttctcagattgggaattatcaaagatgtacttatcatatcagaacaccatgctaacttatctattattctttcttagtaaaacaaaacagccagtaataactatataaaatattaaataacatttccacagaataaattagactttcatgtactctacaattagaaatatccataaatattttcttctggactgtgaacccagataactaggctttctggtcttattttaagtgatgctctttatactatagaagacactcttaatacatcatatatgtatgcagaacatctcttagatgagagaacaagcacatcattggcattccctctgtgccagtttgatgtttgtttgacgatggagctacaagagtctaaatctgcctttgaaaagctcagctcacagtgtagtagagtagactccaaggttcaaaaaagtgtttttaataaaatttggtaagttctacaatcaaggaatgaagagagaagagaacagctttttccatctgggagattcaataatggcttcatatatagatgatagtgtggctaaaaaaaattacatcaatgctgtttctattgggaagcaatggcaagtaatagtatgtcaatactggtcaagtgttgaagccaggatgcacttacacaacgagagtgtaaagtgtgtagggagctgatctgtgaaggagcaactcaaagattttgaaattatcagtgaaatgccaaaacagggaaagtttccctgtttcccttcatctattctacaatgcaccattggttttcagtgtgaaaaatcccaatccctgagcccaaaccacttctggggtcaaaacatttttcttgtgcacaaaatgaatggatcttggtcaaagaagtatggtcacaattttctagcatatattgcgtttataatttagcagaaattctgcaataaataaaggaaaatctgttttacctgtgcaacaatcagaaatggtaaaaatgcattcaagtgtttgaaagaaatggtagaatatgcttgcatagtgctttatagtttcaaagtgctgtcaggtacatcgtccgtttagctcctcacgcactttgtagggtacaagcatcatgttccatctgggttgtggctgattttcatggatggcttgtggcatcagtttcattacttcatagtcacaattctgtgtttcatcttgagaaatgtggagactaatgtttgtaccagtatattccacattcagtgaggtttccaagatgcttcctccaaactctcactttcttaaacagatacatttaaaatatgacaccttctgaaaagtccataaagaaattagtatattcatggaaaaaatttccccgtagacttatttgcatttcatgacttgacatgagaaatttaaaaaacagaaggcaaaatgtgattgcttttgatggatttatacagaatagtcatttaattttctcaagtattatttggaaacaagataatggaaaacattaatcagaagccttattttatttttaaatttttaatagggatggatctagtaagccctaatagctgagttccagtgataaaattcacaaattttatttatgattggaccacttctaacaaggcaaatatcttataatgaagataggagtctgttcaatttaaccttattcaggaaactccgtatttatgtgaaatgatgcaatgccattattaagaggtatctgtaaccctgcataataaaaacatgcataagaagaatgtggtctaatctccaaactgagtctcagtttcagggccttttgctttctttgtttgtttgtttgagacagtctggctctgtcatccaggctggagtgcagtggcacatgagctcactgcaacctccacctcccaggctcaagcgatcctcccacctcagcctcctgagtaactgggactacaggcgcataccaccacacctggctaatttttgtatttttgtagagacaaggcccaggcacgtctcaaactcttgagctcaagcgatccgcccgccttggcctcccaaagtgctaggagtaattataggtgtgagccaccatgctggcagttgtttttgtttatttgtgataaggtctggctgtcacccatgctggagtgcagtggcatgatcttggctcactgcaacctctgccttccaggctcaagccagcctcccacctcagcctccgagtagctaggactacaggcatgcaccaccatgcccagctaatttttttatattttttgtagacacagggttttgccacgttgcccaggctggtcttgaactcctgagctcaagcagtcctcccaccttggcctcccgaagtgctgggattacagacgtgagcctctgggccttgctctgttttgtctgctttctgatttagtaggtgagggacagcactctggaccttagccattttacttccatcttactgccgtgagtttgatgagaatgtcacttttagactctaattttcaaaaacttagtttctttcccattcatttgtgttttccaaattaatttgtttgtctagtatggatgcaaaggaatgctgaagacattaaagctttctgaattgtggcttaaggccagctactgcccactgaaaggatgataaaaataaaaaaggaggaaagaggagcccagcagttgtgccaccccgcaagaatataatgctaattattgaccaactgtcaagattcagagtggtaactgcattccgaggagctgtcaggaaggatgaccgtgtgtgtgctgtccatatcatagccatctgggtcagaaggagcgaaaggatggttaggacaggagtgtagtggagggaaagttaaaacaacggtagatggatcatcttagggcttgctggtgggggtaggaacatacttcaatttggtttcagactgagaagaagaaagctatgctccctgatgaaggcacagtttgatctactagatgggaaataccctcattttataacttcagtaatttaacattttctgtattgcaaagtggaatttagtcccaaagtattaaagctaaccatagcttgatcaggagatttgacaatttagcataaaattatgttgtggatttttttatttaagaattattgttactattattgaacaccatgtatgaaatgaaagaaagggtgcttttatttcattatacttatttggtttttttagcggacatcccttgacattagaatagcatttgagacattttcatgatttctaaagataacttaaatgctctctgttaatctggaaagtgaaatcctaagagtgaggttgcaaatggagactaaattagtgtttccaagtcaggaagttaatcaagaccggaaatagatttgcttagattttatctgcagagtcgtttatttggctttcgtaattgaacagctcagcagaataagatggccctagttgtatggtttctggggaacacaggagaattaaatttatatatgtgatttttatgtgtagtgcccttgggcaggtgatatctttctatatgacttttaagatattacaacctgaggagtgtggatagccgtgttgtgtgattcaaactgaatcagctattactgatgcaggtaaggaaccatcagtcaacttctggttactatcaccttcataaaaaagaatggatgatgttcaggaattaccttggaaggattaaccaggaattaacacagaatgggatgttcttttaggaccctaatgctctaaaagataaaattacaacctatttttctttatatgatagcataagtaaaatttggggctgttaatatgttggaaagtgcttaaaattacatgtttttataatagggatgcaggcattccaaaataaatgaataaaaatacatgcatctctctcgcctcttactgaaagtattaatctaattttatagtaatgattactttttaatattaaggctctgtaaaaaaattatttctaagatttcagtagaacacaggtggtgtatttttttaagcttttaatttctcttcaccaacctcagtcattacgttcaccacacagtgtgtcacagttaatagtggtatttcagtttttgcgttgatttaagcttcatatttatttaatgtgacttttgatggagaataataatgggagatgcttgctgttagcattaaggttatacagctctcacttcaccttatatgtaatttttttttcaaagtaaataatgcagattgttgacatcctagaaatggtttctgggtggtattatatggggcctaggactctgaactgggactagttgtttattttctgggaagtctgtattcttattctcaactgaacccctgactcttttgttgtattttttatgattccgaaatgctttgagggaaagatattttaatgtgtacaatttgttttattttcatactgatctctatttttgtttaaaaccatgttgcatcatgaaatcacttaatccaaaataaatcttctttaaaaaaaata
